United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 7

SEQ ID NO: 12741 - protein, 443 aa, Glycine max
MGLESVGDLAIHVILSKLGAQDTARVACVSKRFCSSASDDTLWINHCFHELALTQPLDHLGNPLSSFKECYQAWRGAFVMYPWSLVKRVKRCWDKIKTWLTNNFPEAEATLCKGATEADIQELENVLKVKLPLPSRILYRFHNGQEIAKADPETTTYGSSLGLIGGYSFYSHLVNVYLLPIRQIILETKQTRRHLSFLRRSKYVLVAASSTYSRKLFFLNCTNGQLYVGTRDLLTEGDIIPCVPHDLINLHQELNISEQQDAMLLWLEEHGRRLEHGFIKLHDKGNGKSINLFPEEPPLCSMAVTNGVKVRASALVIPELIDLQDDLEKYLFAYSIRLSLEPQGCTINGMSFSSCQLHWRHWIIRANDIVISDVNGEAVIGQYPLLRPGAQEFVYQSRMHLPTPSGSIEGSFTFIPGRLADPKGDPFLATVARFPLQLPDYIF

SEQ ID NO: 12742 - protein, 443 aa, Glycine max
MGLESVGDLAINVILKKLGAQDIARVACVSKRFSSSASDDTLWINLCFNELALTQPLDHLGNPLSSFKECYLAWRGAFVMYPWSLVKRVKRCWDRIKTWLTNNFPEAEATLCKGATEADIQELENVLKVKLPLPTRILYRFHNGQEFAKADPETSTFGRSLGLIGGYSFYGHLVNVYLLPICQIILETQQTRRRLSFLRRSKYVLVAASSTYSRKLFFLNCTNGQLYVGTRSPLTERDIIPCVPHDLISLHQELNSSEQQDAMLLWLEEHGRRLEHGFIKLHDEGNGKSINLFPEEPHICSTAVTNGVKVRASALVIPELMDLQDDLGEYLFAYSIRLSLEPQGCIINGMSFSSCQLHWRHWIIRANDIVISDVSGKAVIGQFPLLRPGAQEFVYQSCTPLPTPSGSIEGSFTFIPGRLADPKGDPFLATVARFPLQLPDYIF

SEQ ID NO: 12743 - protein, 443 aa, Cajanus cajan
MGLESVGDLAINVILKKLGAEDIARVACASKRFRSSASEDTLWMNLCFHELALTQPQDHLGNLLPSFKECYQTWRGAFSMYPWSLVRRVKRCWDRIQTWLANNFPEAEATLCKGATEADIEELENVLKVKLPLPTRILYRFHNGQEIAKTDLETSTFGSSLGLIGGYSFYSHLVNVYLLPIRHIILETQQHRRCRGFLRRSKFVLMAASSTHSEKLFFLNCTNGQLYVGTRNILTDRDIIPCVPHDLIHLHQEVNSGEQQDAMLLWLEEHGHRLEHGVIKLRDEVNGRSINLFPEEPPFCSTAITNGVKVCASALVIPELIDLQHDFEKYLFAYSIRMSLEPQGCIINGMTFNSCQLHWRHWIIRANDIVVSDVNGEAVIGQFPLLRPGAKEFVYQSCTPLPISSGSIEGSFTFIPGRLAEPKGDPFLATVAHFPLQLPEYIF

SEQ ID NO: 12744 - protein, 150 aa, Vigna unguiculata
MSRHPEVLWAQRSDKIYLTVALPDAKDVSVKCEPQGLFSFSASGTQDESYSFSLELYGSIEPEGCKTKSSLRNILCSIQKGEKGWWKRLLKSEEKPAPYLKVDWNRWCDEDEESTSDLVSDDDSRFVGQDEGSSDDDGMLYLPDLEKARG

SEQ ID NO: 12745 - protein, 150 aa, Vigna unguiculata
MSRHPEVLWAQRSDKVYLTVALPDAKDVSVKCEPQGLFSFSASGIQDESYSFSLELYGSIEPEGCKTKSGLRNILCLIQKGEKGWWKRLLKSEEKPAPYLKVDWNRWCDEDEESISDLVSDDDSRFVGQDEGSSDDDGMLYLPDLEKARG

SEQ ID NO: 12746 - protein, 151 aa, Glycine max
MSRYPEVLWAQRSDKVYLTVALPDAKNVSVKCEPQGLFTFSASGVQEEAYSFSLELYGCIEPEGCKTKSGLRNILCSIQKGEKGWWKRLLKSEEKPAPYLKVDWNRWCDEDDEESTSDLVSDDDARFVGEDDGSSDDEGMLYLPDLEKARG

SEQ ID NO: 12747 - protein, 150 aa, Lotus japonicus
MSRHPEVLWAQRSDKVYLTVALPDAKDVSVKCEPHGLFSFSASGVQHEPYSFSLELYGSIEPEGCKIKAGLRNILCSVQKGQKGWWKRLLKSEDKPAPYLKVDWNRWCDEDDEESASDLASDDDAPFGQDDGSSDDDGMLYLPDLEKARG

SEQ ID NO: 12748 - protein, 145 aa, Glycyrrhiza uralensis
MSRHPEVLWAQRSDKVYLTVALPDAKDVSVRCEPQGLFSFSASGVQGESYSFSLELYGSIEPEGCKTKSGLRNILCSIQKGQKGWWKRLLKSEEKPAPYLKVDWNKWCDEDDEESASDMDDDARFAGQDDESSDDEGMLYLPDLE

SEQ ID NO: 12749 - protein, 152 aa, Arachis hypogaea
MSRHPEVLWAQRSDKVYLTVALPDAKDVSVKCEPHGLFTFSASGAQGESYSFTLELYGPIAPERCRTKAGLRNILCYVQKAEKGWWKRLLKSEEKPAPYLKVDWHRWCDEDDEESTSDLASDDDTRFVGQDEGSSDEDEGMLYLPDLEKARG

SEQ ID NO: 12750 - protein, 152 aa, Arachis hypogaea
MSRHPEVLWAQRSDKVYLTVALPDAKDVSVKCEPHGLFTFSASGAQGESYSFTLELYGPIAPERCRTKAGLRNILCYVQKAEKGWWKRLLKSEEKPAPYLKVDWHRWCDEDDEESTSDLASDDDTRFVAQDEGSSDEDEGMLYLPDLEKARG

SEQ ID NO: 12751 - protein, 151 aa, Arachis hypogaea
SRHPEVLWAQRSDKVYLTVALPDAKDVSVKCEPHGLFTFSASGAQGESYSFTLELYGPIAPERCRTKAGLRNILCYVQKAEKGWWKRLLKSEEKPAPYLKVDWHRWCDEDDEESTSDLASDDDTRFVGQDEGSSDEDEGMLYLPDLEKARG

SEQ ID NO: 12752 - protein, 151 aa, Cicer arietinum
MSRHPEVLWAQRSDKVYLTVALPDAKDVTVKCEPHGLFSFSASRVQHESYSFSLELYGSIEPGGCKTKTSSRNILCSIQKGQRGWWKRLLKSEEKPAPYLKVDWNKWCDEDEESDYELISDDDGRFAGEDDESSDDEGMLYLPDLEKARGK

SEQ ID NO: 12753 - protein, 150 aa, Lupinus angustifolius
MSRHPEVLWAQRSDKVYLTVALPDAKDVSVKCEPHGLFTFSASHVQGDSYSFTLELYGSISPEGCKTKTGLRNILCSVQKAQRGWWKRLLKSEEKPAPYLKVDWHRWCDEDDEESASDADDDDARFVSQDDESSDDEGMLYLPDLEKARV

SEQ ID NO: 12754 - protein, 151 aa, Medicago truncatula
MSRHPEVLWAQRSGKVYLTIALPDAKDVSVKCEPQGLFIFSASRVQHESYSFSLELYGSIQPEGCKTKTGSRNILCSIQKGQRGWWKRLLKSEEKPAPYLKVDWNKWCDEDEESESEPISDDDGRFAGEDDESSDDEGMLYLPDLEKARAK

SEQ ID NO: 12755 - protein, 150 aa, Lupinus angustifolius
MSRHPEVLWAQRSDKVYLTVALPDAKDVSIKCEPHGLFTFSASHVQGDSYSFTLELYGPISPEGCKTKTGLRNILCSVQKAQKGWWKRLLKSEEKPAPYLKVDWHRWCDEDDEESASDADDDDARFVGQDDESSDDEGMLYLPDLEKARV

SEQ ID NO: 12756 - protein, 152 aa, Vaccinium corymbosum
MSHPEVLWAQRSDKVYLTIALPDAKDVSVKCEPQGLFSFSAKGVQGKSFDFSLELYGNIAPEGCKSKAGLRNILCSIQKEQKGWWKRLLKTEEKPAPYIKVDWNKWCDEDDEESTSSDLASDDDVPFTGEDDGSSDDEGMLYLPDLEKARGN

SEQ ID NO: 12757 - protein, 151 aa, Trigonella foenum-graecum
MSRHPEVLWAQRSDKVYLTVSIPDAKDVSVNCEPHGLFTFSASRVQHESYSFSLELFGSIQPEGCKTKTSSRNILCSIQKGQRGWWKRLLKSEAKPAPYLKVDWNKWCDEDEESESEPISDDDGRFAGEDDESSDDDGMLYLPDLEKARGK

SEQ ID NO: 12758 - protein, 97 aa, Quercus alba
MSRNPEVLWAQRSDKVYLTVALPDAKDISVKCEPQGKFSFSARGVQGESFDLSLELYGAIVPEGCKTKVGLRNILCSIPKGLVEKIVKVRRKTCTVH

SEQ ID NO: 12759 - protein, 150 aa, Lupinus angustifolius
MSRHPEVLWAQRSDKVYLTIALPDAKDVSIKCEPHGLFTFSASHVQGDSYSFTLELYGPISPEGCKNKTGLRNILCSVQKAQKGWWKRLLKSEEKPAPYLKVDWHRWCDEDDEESASDADDDDARFAGEDGESSDDEGMLYLPDLEKARV

SEQ ID NO: 12760 - protein, 153 aa, Theobroma cacao
MSRHPEVLWAQRSDKVYLTISLPDAKDISVICDPQGLFSFSAMGVQGESFDFSLELFGKIVPEGCKTNVGLRNIICSIQKEEKGWWKRLLKSEEKPAPYIKVDWNKWCDEDEEESNSDLASDDDDAMYVGQDDESSDDEGLLYLPDLEKARGN

SEQ ID NO: 12761 - protein, 1886 aa, Medicago truncatula
MGTASRQLKVMLRKNYLLKIRHPFVTAAEILLPAIVLMLLAAVRTQVDTQIHPAQSHIQKDMFVEVGKGVSPNFQQVLESLLDKREYLAFVPDTNETRMMIDVVSIKFPILKHVSIVYNDELELETYIRSDAYGTCNDVRNCSNPKIKGAVVFHEQGPQSFDYSIRLNHTWAFSGFPDVTTIMDTNGPFLNDLELGVSAVPTMQYSLSGFLTLQQMVDSFIIIIAQQHELNLSAETVNLPLLGFHDTDFSRKVPWTQFNPTNIRIAPFPTREYTDDQFQAIVKEVMGILYLLGFLYPVSRLISYSVFEKEQKIKEGLYMMGLNDSIFHLSWFVTYAFQFAISSAVITACTMDNIFKYSDKTLVFAYFFIFGLSAIMLSFFISTFFKRAKTAVAVGTLSFLGTFLPYYSVNDEGVSMILKVLASLLSPTAFALGSINFADYERAHVGLRWSNIWRESSGVNFSACLLMMILDTLLYCAIGLYFDKVLPREYGLRYPWNFIFKKDLWRKRSSSSKIKFTGKSSESEGNLLGRGIFNPALEAISLDMKQQELDGRCIQIRNLHKVYATKKGDCCAVNSLQLTLYENQILALLGHNGAGKSTTISMLVGLLPPTSGDALIFGKNIVSDIDEIRKVLGVCPQHDILFPELTVREHLELFAILKGVDEDTLESVVINMADEVGLADKINTVVRSLSGGMKRKLSLGIALIGNSKVIILDEPTSGMDPYSMRLTWQLIKKIKKGRIILLTTHSMDEADELGDRIAIMANGSLKCCGSSLFLKHHYGVGYTLTLVKSAPTASIAGDIVYRYVPTATCISEVGTEISFRLPMASSSTFERMFREIESCMKKPVSSMEISGNCEKDSHGIESYGISVTTLEEVFLRVAGCDYDEDECFEENNRSLISEAVVSLPSNDRPSTKICYYKVCGNYKKILGFMSTMVGRACGLIFATVISFVNFISLQCCSCCLITTSTFWQHSKALIIKRAISARRDHKTIIFQLMIPAIFLFIGLLFLELKPHPDQISLTLSTSYFNPLLSGGGGGGPIPFNLSFPIAEEVAQNVKGGWIQRCNSSSYKFPNSEKALVDAVEAAGPALGPALLNMSEYLMSSFNESYQSRYGAIVMDDQNTDGSLGYTVLHNFSCQHAAPTFINLMNSAILRLATHNVNATIQTRNHPLPMTQSQHLQRHDLDAFSAAIIVNIAFSFIPASFAVSIVKEREVKAKHQQLISGVSVLSYWISTFIWDFVSFLFPASFAIVLFYIFGLDQFVGGVSLIPTIIMLLEYGLAIASSTYCLTFFFFDHTVAQNVVLLVHFFSGLILMVISFIMGLLPSTISANSFLKNFFRISPGFCFADGLASLALLRQGMKDKTSDGVYDWNVTGASICYLAVESFIYFLLTLGLEIYPSLKLTPFKIKKWWGKINIFPHNTSYLEPLLESSPETFVTDLNEDVDVKTERNRVLSGSIDNAIIYLRNLRKVYSEEKNHGKKVAVDSLTFSVQEGECFGFLGTNGAGKTTTLSMLCGEESPSDGTAFIFGKDICSHPKAARKYIGYCPQFDALLEFLTVKEHLELYARIKSVPDYTIDNVVMEKLVEFDLLKHANKPSFSLSGGNKRKLSVAIAMIGDPPIVILDEPSTGMDPIAKRFMWDVISRISTRRGKTAVILTTHSMNEAQALCTRIGIMVGGQLRCIGSPQHLKTRFGNHLELEVKPTEVSSVDLQTLCQTIQEILFDVPSQPRSLLNDLEICIGGADSVTSGNTSIAEISLTSEMIGLIGRWLGNEERVKTLTCCTPVYDGASQEQLSEQLLRDGGIPLPVFSEWWLSKQKFSEIDSFILCSFRGAKCQGYNGLSIRYQLPCDEDFSLADVFGLLEASRDKLGIAEYSLSQSTLETIFNHFAANS

SEQ ID NO: 12762 - protein, 1890 aa, Cicer arietinum
MGTSWRQLKVMLRKNCLLKIRHPFVTAAEILLPAIVLLLLAAVRTRVDTQIHPAQSLVFYSSISIGKGISPNFQQVIESLLDKKEHLAFAPDTKETRMMIDVVSIKFPLLKLVSIVYKDEVELETYIRSDAYGICHDIRNCSNPKIKGAVVFYEQGPQSFDYSIRLNHTWAFSGFPDVTTIMDTNGPFLNDLELGVSAVPTMQYSFSGFLTLQQMVDSFIILIAQQPELNSVADTVKLPLLGFHDTDFSLKVPWTQFNPTNIRIAPFPTREYTDDQFQAIVKEVMGILYLLGFLYPVSHLISYSVHEKEQKIKEGLYMMGLKDGIFHLSWFITYALQFAISSAVITACTLDNIFKYSDKTLVFAYFFIFGLSAIMLSFFISTFFKRAKTAVAVGTLSFLGAFFPYYTVNDAGVSMVLKVLASLLSPTAFALGSVNFADYERAHVGLRWSNIWRESSGVNFSICLLMMILDTLLYCAIGLYFDKVLPREYGLRYPWNFIFRKDFWREKKIVNTCSSSFKVRISGKNSESEGNPLGQDTFKPAIEAISLDMKQQELDGRCIQIRNLHKVYGTKKGDCCAVNSLQLTLYENQILALLGHNGAGKSTTISMLVGLLPPTSGDALIFGKNIVSDIDEIRKVLGVCPQHDILFPELTVREHLELFAILKGVQQDTLEDVIINMADEVGLADKINTVVKSLSGGMKRKLSLGIALVGNSKVIILDEPTSGMDPYSMRLTWQLIKKIKKGRIILLTTHSMDEADELGDRIAIMANGSLKCCGSSLFLKHHYGVGYTLTLVKSAPTASIAGDIVYRYVPTATCISEVGTEISFRLPMASSSTFERMFREIEGCMKKPVSNMEISGSCEKDSHGIESYGISVTTLEEVFLRVAGCDYDEVECFEENNNSLISDYVVSLPSNDCPSTKTCCLNVFGNYKNILGFMSTMVGRACDLILATVISFVNFVGMQCCSCCLITRSTFWQHSKALVIKRAISARRDHKTIIFQLMIPALFLFIGLLFLELKPHPDQISLTLSTSYFNPLLSGGGGGGPIPFNLSFPIAEKVVQNVKGGWIQTCNPSSYKFPNSEKALADAVEAAGPTLGPSLLSMSEYLMSSFNESYQSRYGAIVMDDQNTDGSLGYTVLHNFSCQHAAPTFINLMNSAILRLTTRNINATIQTRNYPLPMTRSQHLQRHDLDAFSAAIIVNIAFSFIPASFAVSIVKEREVKAKHQQLISGVSILSYWASTFIWDFVSFLFPASFAIILFYIFGLDQFVGGVSLLPTIIMLLEYGLAIASSTYCLTFFFFDHTVAQNVVLLVHFFSGLILMVISFVMGLIPSTKSANYFLKNIFRISPGFCFADGLASLALLRQGMKDKTSDGVYDWNVTGASICYLGVESLIYFLLTLGLEFFPSLKLTSFMIKKWWGKINIFPNNISYLEPLLEPSPETFVTDEDVDVKTERNRVLSGSVDNAIIYLRNLRKVYSEDKNHGKKVAVDSLTFSVQEGECFGFLGTNGAGKTTTISMLCGEESPSDGTAFIFGKDICSHPKAARKYIGYCPQFDALLEFLTVKEHLELYARIKSVPDYTINNVVMEKLVEFDLLKHANKPSFSLSGGNKRKLSVAIAMIGDPPIVILDEPSTGMDPIAKRFMWDVISRISTRRGKTAVILTTHSMNEAQALCTRIGIMVGGQLRCIGSPQHLKTRFGNHLELEVKPTEVSSVDLKTLCQAIQEILFDVPSQPRSLLNDLEICIGGADSITSGNTSVAEISLTPEMIGLIGRWLGNEERVKTLICSTPDYDGASQEQLSEQLFRDGGIPLPVFSEWWLSKQKFSEIDSFILSSFRGARCQGHNGLSIRYQLPYDEEFSLADVFGLLEGNRERLGIAEYSISQSTLETIFNHFAANYS

SEQ ID NO: 12763 - protein, 231 aa, Vigna unguiculata
MARAISSSCARFTMRLLSTSTFTAALPKPSTLSLPSRRFLFPLSHAIVPPSTRVAGIRCRVNRAGDSAYSPLNSGSSSFSDRPPTEMAPLFPGCDYNHWLIVMDKPGGENANKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENTQ

SEQ ID NO: 12764 - protein, 229 aa, Cajanus cajan
MARAISSSCARLTMRLLTTTTTTATLLRPSTLSSRRFLFPLSHAIVAPSTRVAGIRCRVNRAGDSAYSPLNSGSSSFSDRPPTEMAPLFPGCDYNHWLIVMDKPGGEGATKQQMIDCYVETLAKVLGSEEEAKKKIYNVSCERYFGFGCEIDEETSNKLEGLPGVLFVLPDSYVDPENKDYGAELFVNGEIVQRPPERQRRVEPQPQRHQDRPRYNDRTRYVRRRENNQ

SEQ ID NO: 12765 - protein, 237 aa, Glycine max
MARVISSSCARLAMRLFSTTTTATAFAVTLPKPSSLSLSSRRFLFPLSHAIVPPSTRVAGIRCRVNRAGDSAYSPLNSGSSSSSFSDRPPTEMAPLFPGCDYNHWLIVMENPGGEGANKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENMQ

SEQ ID NO: 12766 - protein, 237 aa, Glycine max
MARAVSSSCARLSMRLFSTTTTAAFAVSLPKPSSLSVSTRRFLFPLSHAIVPPSTRVAGIRCRVNRAGDSAYSPLNSASSSSSSFSDRPPTEMAPLFPGCDYNHWLIVMDHPGGEGATKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENTQ

SEQ ID NO: 12767 - protein, 242 aa, Glycine max
MARAVSSSCARLTMRLFSTTTTTTTTTAAFAVTLPKPSSLSVSTRRFLFPLSHAIVPPSTRVAGIRCRVNRAGDSAYSPLNSASSSSSSFSDRPPTEMAPLFPGCDYNHWLIVMDHPGGEGATKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENTQ

SEQ ID NO: 12768 - protein, 243 aa, Lupinus angustifolius
MASRSLWSSSSARLSTLLTTRVFSSTTTTAATASITKPPSLTSLILPRRRPLLPLSNATIFPQTTRFGGIRCRVNRAGDSAYSPINSGSSFSDRPPTEMAPLFPGCDYQHWLIVMDKPGGEGANKQQMIDCYVQTLAKVLGSEEEATKKIYNVSCERYFGFGCEIDEETSNKLEGLPGVLFVLPDSYVDPEYKDYGAELFVNGEIVQRPPERQRRVEPQPQRHQDRPRYNDRTRYVRRRENMR

SEQ ID NO: 12769 - protein, 237 aa, Lupinus angustifolius
MATTTKILWPCSSTRLSTLLTMRLFSTTTTATSIIKPPPLPFLSLPIRRSLLPLSNATTRFGGIRCRVNRAGDSAYSPLNSGSSFSDRPPTEMAPLFPGCDYQHWLIVMDKPGGEGATKQQMIDCYIQTLAKVLGSEEEAIKKIYNVSCERYFGFGCEIDEETSNKLEGLPGVLFVLPDSYVDPEYKDYGAELFVNGEIVQRSPERQRRVEPQPQRHQDRPRYNDRTRYVRRRENTR

SEQ ID NO: 12770 - protein, 377 aa, Glycine max
MQVFSNARQASRLLLSPHLRSSEAPHSTALSLFSGLTQRDSRPVNTDPIQCFLSKAFYSSGVGTVEATPSEDVKELYDKMLDSVKVKRSMPPNAWLWSMIANCKHQPDIRLLFDILQNLRRFRLSNLRIHDNFNCNLCREVAKACVHAGALDFGMKALWKHNVYGLTPNIASAHHLLTNAKNHNDTKLLVEVMKLLKKNDLPLQPGTADIVFSICYNTDDWELINKYAKRFVMAGVKLRQTSLETWMEFAAKRGDIHSLWKIEKLRSNSMKQHTLITGFSCVKGLLLERKPSDAVAVIQVLNQTLSDTKKSGIKGELQKLVSEWPLEVIKHQKEEDRKALAASLKSDILVMVSELLSMGLEANVSLEDLDRKEDIPQ

SEQ ID NO: 12771 - protein, 221 aa, Vigna unguiculata
MSQLNGAYYGPAIPPQKSYNRPGRGGGLGCCCGCLFSCIFSLIFKVIFTLIIIVAIAVFIFWLIVRPNMVKFHVTDATLTEFNYSNNTLHYDLALNITVRNPNKRLGIYYDFIEARALFHDARFNSQYPNPFYQGHKTTNVLNPVFKGNQVMALDADQSAELSKENSTGLYEIDVKMYLRVRFKLGAFKTKTLKPKVSCDLRVPFKGTATAFQTTKCDWDR

SEQ ID NO: 12772 - protein, 221 aa, Glycine max
MSQLNGAYYGPSIPPPKTSYHRPGRGGGLGCCCGCLFSLIFKLILTVIIIIGIAVFLFWLIVRPNVVKFHVTEATLTQFNYTPNNTLHYDLALNITVRNPNKRLGIYYDRIEARAMFHDARFDSQFPEPFYQGHKSTNVLNPVFKGQQLVPLNADQSAELKKENATGVYEIDVKMYLRVRFKLGVFKTKTLKPKVSCDLRVPLKGSAGAGVFQTTKCDWDR

SEQ ID NO: 12773 - protein, 216 aa, Glycine max
MSQLNGAYYGPSIPPPKTSYHRPGRGGGCCCGCLFSLIFKLILTVIIIVGIAGFVFWLIVRPNVVKFHVTDATLTQFNYTANNTLHYDLALNITVRNPNKRLGIYYDRIEARAMFHDARFDSQFPEPFYQGHKSTKVLNPVFKGQQVVPLNAEQSAELKKENATGVYEIDVKMYLRVRFKLGVLKTKTLKPKVSCDLRVPFKGSAAFETTKCHWDR

SEQ ID NO: 12774 - protein, 337 aa, Vigna unguiculata
MGEEGKKPEEPKVEEKKPEEAEKKQEEKKEETAEKPAGEKKPEATPPPPPPPPEIVLKVFMHCEGCARKVHRSLKGFPGVEEVLTDCKSHKVVIKGEKADPLKVLERIQRKSHRKVELLSPIPKPPEEKVPEEEKPKPKLEEKVQEPPIVTVLKVHMHCEACSLEIKRRIQRMKGVESAEPDLKKSVVSVKGVYDPEKLVEYVYKRTGKHAVIVKPEAEKKEEKVEEAKEEKKEEVEKEKKKSGEGEENKEKKEEEAKGETKAEETAVVAAAATSSEESNKVVPEVKINEYFYNPPRYGMEVYAYPAHPVQPAYPAYFHAYPPQIFSDENPNACTVM

SEQ ID NO: 12775 - protein, 209 aa, Cajanus cajan
MAIDSVYASSPPFQTGPSGHPRHFYLAVDRLQFKMQTVVELVDLVARRPCLPIVVCCSTRDDLDSLCSSLSALPFLSSSALYSDLAEDERAFVLEKFRQVTARWNQMNHGGAPNEDEAGKDERSHMIIVTDACLPLLASGELPLNAHLLINYELPAKKETYGRRLATCLTADGFVINMVVGGEVVTLKSIEESSNIVMQEMPMQILDIL

SEQ ID NO: 12776 - protein, 209 aa, Glycine max
MAIDSVYTSSPPFQSGPSGHSRHFYLAVDRLHFKMQTVIELVDLVARRPCLPIVVCCSTRDDLDSLCSSLSTLPFLSSSALYSDLGEDERSFILEKFRQVTARWNQTNHGGAPNEDEIGKDERSHMIIVTDACLPLLASGEFPLNAHLLINYELPAKKETYGRRLATCLTADGIVINMVVGGEVVTLKSIEESSNIVMQEMPMQILDIL

SEQ ID NO: 12777 - protein, 207 aa, Vigna unguiculata
MDSVYGSSPPFKGGPFGHPRHFYLAVDRLNFKMQTVIELVDLIARRPSLPIVVCCSTRDDLDSLCSSLSTLPFVSSSALYSDLAEDERAFLLEKFQQVTARWNQSNQGGAPSEDEIGKDEKSHMIIVTDSCLPLLSSGELPLNAHLLINYELPAKKETYARRLAACLTSDGIVINMVVGGEVVTLKSIEESSNIVMQEMPMRILDVL

SEQ ID NO: 12778 - protein, 202 aa, Glycine max
MSSYLGVGVSPGNVPVYHSTNVKVLDRKIKITELVLRCVILGLGVLAAVLVGTDSEVKEFFSFQKEAKFTDMKSLVFLVVANGLAAGYSLIQGLRCILSMIRGRVLFSKPLAWAIFSGDQVMAYVTVVALAAAGQSGMIARVGQPELQWMKICNMYGKFCNQVGEGIASAFVASLSMVVMSCISAFSLFRLYGGNKTKNVHW

SEQ ID NO: 12779 - protein, 255 aa, Vigna unguiculata
MKCVALLSVVACAFAAAIWAANGDDSLVPPRREVYGNGRIFDISHRYHPEMPEFDSKDGIGQFLWLPKSMKNGSIANNSEMKLPTHTGTRVDSPGHVFDHYFDAGFDVDTLDLDILNGPALLVDVPRDSNITAEVMKSLHIPRGVIRVLFRTLNSDRRLMFQKEFDASYVGFTVDGAKWLVENTDIKLVGIDYLSVASYDYLIPSHLVFLKDREVILVEGLKLDDVPAGFYSVHCLPLRLSGAEGSPIRCILIKN

SEQ ID NO: 12780 - protein, 255 aa, Glycine max
MKRGALLSVLAFAFAAAIWAANGNDNLVPPRREVYGNGRIFDISHRYQPEMPEWESNNGIGQFLWLPKSMKNGSLANNSEMKLPTHTGTHVDAPGHVFDHYFDAGFDVDTLDLDILNGPALLVDVPRDSNITAQVMKSLNIPRGVVRVLFRTLNTDRRLMFQKEWDTSYVGFTVDGAKWLVDNTDIKLVGIDYLSVASYDYLIPSHLVFLKDREIILVEGLKLDDVPAGLYSVHCLPLRLAGAEGSPIRCILIKN

SEQ ID NO: 12781 - protein, 223 aa, Glycine max
MKRGALLSVLAFAFAAAIWAANGNDNLVPPRREVYGNGRIFDISHRYQPEMPEWESNNGIGQFLWLPKSMKNGSLANNSEMKLPTHTGTHVDAPGHVFDHYFDAGFDVDTLDLDILNGPALLVDVPRDSNITAQVMKSLNIPRGVVRVLFRTLNTDRRLMFQKEWDTSYVGFTVDGAKWLVDNTDIKLVGIDYLSVASYDYLIPSHLVFLKDREIILVEGFEA

SEQ ID NO: 12782 - protein, 255 aa, Glycine max
MKRGALLSVLACAFAAVIWAANGDDNLVPPRREVYGNGRIFDISHRYQPEMPEWESNDGIGQFLWLPKSMKNGSLANNSEMKFPTHTGTHVDAPGHVFDHYFHAGFDVDTLDLDILNGPAMLVDVPRDSNITAQVMKSLNIPRGVIRVLFRTLNTDRRLMFQKEWDSSYVGFTADGAKWLVENTDIKLVGIDYLSVASYDYLIPSHLVFLKDREIILVEGLKLDDVPAGLYSVHCLPLRLAGAEGSPIRCILIKN

SEQ ID NO: 12783 - protein, 255 aa, Cajanus cajan
MKRGAVSLIACAFAVALWAANGEDGALVPPRREVYDNGRIFDISHRYQPEMPDWESKEGIGQFLWLPKSMKNGSLANNSEMKLPTHTGTHVDAPGHVFDHYFDAGFDVDSLDLHVLNGPALLVDVPRDTNITAQVMKTFNIPRGVKRVLFRTLNTDRKLMFQKEFDTSYVGFTVDGAKWLVENTDIKLVGIDYLSVASFDYLIPSHLVFLKDREIILVEGLKLDDVPAGLYSVHCLPLRLAGAEGSPIRCILIKN

SEQ ID NO: 12784 - protein, 253 aa, Trifolium pratense
MKYQAAVLSLVVAIYTSAVIGDDNLIPPRREVYNNGKIFDITHRYQPDMPAFESSDGIGQFLWLPKSMKNGSIANNSEMKLPTHTGTHVDAPGHVFDHYFDAGFDVDSLDLHILNGPALLVDVPRDSNITAEVMKSLNIPRGITRVLFRTLNTDRRLMFQKEFDSSYVGFTVDGAKWLVENTDIKLIGVDYLSVASYDYLIPSHLVFLKDREIILVESLKLDDVPAGLYSVHCLPLRLAGAEGSPIRCIVIKY

SEQ ID NO: 12785 - protein, 253 aa, Cicer arietinum
MKCEAVAFILVVAILASAVTGDDDLIPPRREVYDNGRIFDITHRYQPDMPEFESKHGIGQFLWLPKSMKNNSIANNSEMKLPTHTGTHVDAPGHVYDHYFDAGFDVDSLDLHILNGPALLVDVPRDSNITAEVMKSLNIPRGVKRVLFRTLNTDRRLMFQKEFDSNYVGFTVDGAKWLVENTDIKLVGIDYLSVASYDYLIPSHLVFLKDREIILVESLKLDDVPAGLYSVHCLPLRLAGAEGSPIRCILIKY

SEQ ID NO: 12786 - protein, 254 aa, Trigonella foenum-graecum
MKYEAIVVLVLVVTISSSAVNGDDNLIPPRREVYDNGRIFDITHRYQPDMPAFETKDGIGQFLWLPKSMKNGSIANNSEMKLPTHTGTHVDAPGHVFDHYFDAGFDVDSLDLHILNGPALLVDVPRNSNITAEVMKSLNIPRGVKRVLFRTLNTDRRLMFQKEFDSNYVGFTVDGAKWLVENTDIKLVGIDYLSVASYDYLIPSHLVFLKDREIILVESLKLDDVPAGLYSVHCLPLRLAGAEGSPIRCILIKY

SEQ ID NO: 12787 - protein, 252 aa, Lotus japonicus
MKFGALLVAVCALTVAVCAEALPGDENLVPPRREVYDGGRIFDISHRYHPDMPSWESDDGIGQFLWLPKSMKNGSIANNSKMKLPTHTGTHVDAPGHVFDHYFDAGFDVDSLDLHILNGPALLVDVPRDSNLTAEAMKSLNIPRGVKRVLFRTLNTDRRLMFKKEWDTSYVGFTKDGAKWLVENTDIKLVGIDYLSVAAFDDLIPSHLVFLKDRKSFLLKPSSLMMSQQDYIQSIACLLDWLVLRDHQSDAF

SEQ ID NO: 12788 - protein, 254 aa, Medicago truncatula
MKYQAVVALALVVTISVTAVNGDDNLIPPRREVYDNGKIFDITHRYQPDMPAFETNDGIGQFLWLPKSMKNGSIANNSEMKLPTHTGTHVDAPGHVFDHYFDAGFDVDSLDLHVLNGPALLVDVPRDSNITAEVMKSLNIPRGVKRVLFRTLNTDRRLMFQKEFDSSYVGFTVDGAKWLVENTDIKLVGIDYLSVASYDYLIPSHLVFLKDRESILVESLKLDDIPPGLYSVHCLPLRLAGAEGSPIRCILIKY

SEQ ID NO: 12789 - protein, 203 aa, Vigna unguiculata
MCAPISELEQEELLEKLEVFKIKGRDKHGRKILRIIGKFFPARLITVEVLKKYLEERVFPKLGKRKFAVLYVHTDVQRSENLPGISALRSIYDAIPTNVKENLEAFYFIHPGLQARLFLATLGRFLFNAGLYGKLKYISRVDFLWEHVRRNEVEIPEFVFDHDEDLEYRPMMDYGLESDHARLYGGAPTMDSPVTTYSMRCIS

SEQ ID NO: 12790 - protein, 204 aa, Glycine max
MCAAISEVEQEELLEKLEVFKIKGRDKHGRKILRIIAKFFPARLVSVEVLKKYLEERVFPKLMGKRKFAVLYVHTGVQRSENFPGISGLRWIYDAIPANVKENLEAVYFIHPGLQARLFLATFGRFLFNAGLYGKLRYVSRVDYLWESVRRNEVEIPEFVFDHDEDLDYRPMMDYGLESDHARVYGGAPTMDSPVTTYSMRCIS

SEQ ID NO: 12791 - protein, 203 aa, Glycine max
MCSAISQVEQEELLEKLEVFKIKGRDKHGRKILRIIAKLFPARLVSVDVLKKYLEDKVFPKLGKRKFVVLYVHTGVQRSENFPGISGLRWIYDSIPANVKENLEAVYFIHPGLQARLFLATFGRFLFNAGLYGKLRYVSRVDYLWENVRRNEVEIPEFVFDHDEDLDYRPMMDYGLESDHARVYGGAPTMDSPVTTYSMRCIS

SEQ ID NO: 12792 - protein, 204 aa, Cajanus cajan
MCAVAMSHLQQLELLHKLEVFKIKGRDKHGRKILRIIAKFLPARLVSVDVLNKYLEERIFPKLGKRKFAVLYVHTGVQRSENFPGISGLRWIYDAIPAAVKDNLEAVYFIHPGLQARLFLATFGRFLFNAGLYGKLRYVSRVDYLWESVRRNEVEIPEFVFDHDEDLEYRPMMDYGLESDHARVYGAAPALDSPVTTYSMRCIS

SEQ ID NO: 12793 - protein, 203 aa, Medicago truncatula
MSTTITELEQEELLEKLEVFKIKGRDKHGRKILRIIGKFFPARLVSVEVLKKFLEERIFPKLGKKKFAVLYIHTGVQRSENFAGISSLRSVYDAIPANVKENLEAVYFIHPGLQARLFLATFGRFLFNAGLYRKLRYISRIGYLWENVRRTEVEIPEFVYDHDEDLEYRPMMDYGLESDHARVYGTAPALDSPVTTYSMRCIS

SEQ ID NO: 12794 - protein, 203 aa, Cicer arietinum
MSTAITELEQEELLEKLEVFKIKGKDKHGRKILRIIGKFFPARLVSVDVLKKYLERRIFPKLGKRKFSVLYIHTGVQRSENFPGISSLRSLYDAIPANVKENLEAVYFIHPGLQARLFLATFGRFLFKAGLYGKLRYVSRVDCLWENVRRNNVEIPEFVYDHDEDLEYRPMMDYGLESDHARVYGTAPSLDSPVTTYSMRCIS

SEQ ID NO: 12795 - protein, 205 aa, Lotus japonicus
MNPSNSISQFEQEELLDKLEVFKIKGRDKQGRKILRIIGKFFPARLVSVDVLKKYLEERIFPKLVKKKFSVLYVHTDVHRSENFPGISALRSIYDAIPANVKENLEAVYFIHPGLQSRLFLATFGRFLFNAGLYGKLRYVSRVDYLWESVRRNEVEVPEFVFDHDEDLEYRPMMDYGLESDHARVYGGAPAMDSPVTTYSMRCIS

SEQ ID NO: 12796 - protein, 187 aa, Glycyrrhiza uralensis
MSAAISELAQEELLEKLEVFKIKGRDKHGRKILRIIGKFFPARLVSVEVLKKYLEERVFPKLGKKKFSVLYVHTGVQRSENFPGISSLRSIYDAIPANVKENLEAVYFIHPGLQARLFLATFGRFLFNAGLYGKLRYVSRVDYLWENVRRIDVEIPEFVFDHDEDLEYRPMMDYGLESDHARVYGGA

SEQ ID NO: 12797 - protein, 205 aa, Arachis hypogaea
MSGVSSISEAEQEELLEKLEVFKVKGKDKQGRKILRIIGKFFPARFVSVEVLKKYLEERVFPKVGKRKFTVVYVHTGVQRSENFPGISALRSIHDAIPANVRDNLEAVYFIHPGLQARLFLATFGRFLFSSGVYGKLRYVTRVDYLWENVKRNEVEIPEFVFDHDEDLEYRPMMDYGLESDHARVYGVPPTMDSPVSTYSMRCIS

SEQ ID NO: 12798 - protein, 206 aa, Lupinus angustifolius
MSSNATISEIEQEELLEKLQVFKIKGKDKNGRKILRIIGKFFPARLVSVDVLKKYLEERVFPKLGKRKFSVLYVHTGVNRSENFPGISGLRSIYDAIPVNVKDNLEAVYFIHPGLQSRLFLATFGRFLFSAAGLYGKVRYVSRVDYLWEHVRRKEVEIPEFVIDHDDDLEYRPMMDYGLESDHPRVYGAPPTVDSPVSTYSMRCIS

SEQ ID NO: 12799 - protein, 205 aa, Lupinus angustifolius
MNCNAIISEIEQEKLLEKLQVFKIKGKDKRCRKILRIIGKFFPARLVNVDVMNKYLEERVFPKLGKRKFCVLYVHTGVNRTENFPGISALRSIYDAIPANVKENLEAVYFIHSGLQARLFLATFGRFLFSAGLYGKLRYISRVDYLWEHVKRKEVEIPEFVFDHDDDLENRPMMDYGLESDHARVDGGPPTFDSPISTYSMRCIS

SEQ ID NO: 12800 - protein, 77 aa, Glycine max
MGAETESSQEKPAQERPKAALSQEQFLSWKRHKDAAVSARKAEVSRKRAEDIAAGTVQMNGRELFLHEPWVFDNSRY

SEQ ID NO: 12801 - protein, 77 aa, Glycine max
MGAETESSQEKPEQERPKPTLSQEQFLSWKRHKDAAVSARKAEVSSKRAEDIAAGTVQMNGRELFLHEPWVFDNSRY

SEQ ID NO: 12802 - protein, 115 aa, Vigna unguiculata
MAWLQLQRIITKGGVNLISTLPHSSPCSSSRFFSKSSPYMVKVGIPEFLNGIGKGVESHVPKLESEIGDFQKLLVTRTLKLKKLGIPCKHRKLILKYTHKYRLGLWRPRVESIKA

SEQ ID NO: 12803 - protein, 110 aa, Glycine max
MAWLQLQRIVTKGGANLISPLPLSRFFSKSSSPYVVKVGIPEFLNGIGKGVESHVPKLESEIGDFQKLLLTRTLKLKKLGIPCKHRKLILKYTHKYRLGLWRPRVESINA

SEQ ID NO: 12804 - protein, 107 aa, Cajanus cajan
MAWLQLQRIITKISPLPHSTPSRFFSKSSPYVVKVGIPEFLSGIGNGVESHVAKLESEIGDFQKLLVTRTLKLKKLGIPCKHRKLILKYTHKYRLGLWRPRVESIKA

SEQ ID NO: 12805 - protein, 112 aa, Cyamopsis tetragonoloba
MVWLQLQRIIGKGGSNPISTLPHYSSSRFFSKSSPYAVKVGIPEFLNGIGNGVESHAAKLETEIGDFQKLLVTRTLKLKKLGIPCKHRKLILKYTHKYRLGLWRPRAEPIKA

SEQ ID NO: 12806 - protein, 104 aa, Vigna unguiculata
MGIAWLQLQRIITTPCSSSRFFSKSSPYVVKVGIPEFLNGIGKGVESHVPKLESEIGDFQNLLVTRTLKLKKLGIPCKHRKLILKYTHKYRLGLWRPRVESIKA

SEQ ID NO: 12807 - protein, 109 aa, Glycine max
MAWLQLQRIITNTKGGANLISPLPRFFSKCSPYVLKVGIPEFLNGIGKGVESHVPKLESEIGDFQKLLVIRTLKLKKLGIPCKHRKLILKYTHKYRLGLWRPRAEFITA

SEQ ID NO: 12808 - protein, 116 aa, Medicago truncatula
MSLWLQMHRVIRNGSVNLISTHPHSSAYFSSRSYSKSTPYVVKVGIPEFLNGIGKGVESHVAKLDSEIGDFQKLLVTRTLKLKKLGIPCKHRKLILKHAHKYRLGLWRPRAEPIKA

SEQ ID NO: 12809 - protein, 118 aa, Medicago truncatula
MAMSLWLQMHRVIRNGSVNLISTHPHSSAYFSSRSYSKSTPYVVKVGIPEFLNGIGKGVESHVAKLDSEIGDFQKLLVTRTLKLKKLGIPCKHRKLILKHAHKYRLGLWRPRAEPIKA

SEQ ID NO: 12810 - protein, 116 aa, Cicer arietinum
MATAWLQLQRVLRNGGVNSISTLPPSSNYFSSRSFSKSTPYVVKVGIPEFLTGIGNGVESHVAKLDSEIGDFQKLLETRTLKLKKLGIPCKHRKLILKYAHKFRLGLWRPREPIKA

SEQ ID NO: 12811 - protein, 117 aa, Trigonella foenum-graecum
MATLWLQMQRVIRNGSVNLISTHPHSSSYFSSRSYSKSTPYAVKVGIPEFLNGIGKGVESHVAKLDSEIGDFQKLLVTRTLKLKKLGIPCKHRKLILKHAHKYRLGLWRPRAEPIKA

SEQ ID NO: 12812 - protein, 186 aa, Vigna unguiculata
MGSTNLVLSSTLLLLLVGFANSDITQDKADCTDKLIGLAGCLTYASGDASAPTMDCCSGLKQVIDKNKRCLCILIKDRNDPSLGLKINVTLALNLPEVCKTPTNITQCVDLLHLPPNSPDAKVFEGFEKALTNKTSPSSAPAGSAKGETLSGNSKSGGWGKKWLVTEVVCGILPLVLVSHLVLFLV

SEQ ID NO: 12813 - protein, 133 aa, Glycine max
MEASKLSSSDQNVRCHHCAGPLSKDMETSHWTVSPLIRDSFSMIGSAVGGVASAFYGFNLVMPIVQRRIKGPMWLHFLIGAPPVIVFSSACAGLAGGAVPAAAQLVSSSYHAAYSSPTSPPPSKDENIQRSRK

SEQ ID NO: 12814 - protein, 133 aa, Glycine max
MEASKFSNSDQNVRCHHCAGPLSKDMETSHWTVSPLIRDSFSMIGSAVGGVASAFYGFNLVMPIVQRRIKGPMWLHFLIGAPPVIVLSSACAGLAGGAVPAAAQLVSSSYHAAYSSPISPPPSKDENIQRSRK

SEQ ID NO: 12815 - protein, 133 aa, Cajanus cajan
MEASELSSSSEDIRCHHCAGPLSNQMETTHWTVSPLIRDSFSMIGSAVGGTASAFYGFNLVMPVVQRRIKGPMWLHFLIGAPPVIVFSSACAGLAGGAVPAAAQLVSSSYNAAYSTSTLPPPSKDGNIQKSRK

SEQ ID NO: 12816 - protein, 541 aa, Glycine max
MQGSLRNANKSGKASSRERKLALQQDVDRLKKQLRHEENIHRALERAFNRPLGALPRLPPYLPPYILALLAEVAVLEEEIVRLEEQVVHFRQDLYQEAVYMSSSMRKLENSVSAPPNKSNPTLDSPKLDKLKSLTQTAGNSTATSETKPTTTLTEDRQGKENQSCTNSSKSRQQSSNQMNKTPIKNIDSKSLQKRLDHPKRKQEPRVNNQQIADVRNHSPHKNSPEAQSPNIISENILKCLSNILLRMSAVKNPGSTCDMAPLWDLKPQNCDEEADFWDPYGICLEFGKRDIGPYRQLCAIDAKSFNPKRTANTLFLLHRLKLLFRKVASVNLENLNHQEKLAFWINIYNSCMMNAFIENGIPENPQMAVALMRKATINVGGHVLSATTIEHFILRLPYHWKFTFSKGTKNHQMTARSIYGLELSEPLVTFALSSGTWSSPAVRVYTASQVENELEVAKREYLQAAIGFSTSKFAIPKLLDWYLLNFAKDLESLLDWICLQLPSELGKEAIKFLEERKTEPLSQFVQIMPYEFSFRYLICT

SEQ ID NO: 12817 - protein, 540 aa, Cajanus cajan
MKGSLRVANKSGKASSRERKLALQQDVDRLKKKLRHEENIHRALERAFNRPLGALPRLPPYLPPYILALLAEVAVLEEEIVRLEEKVVHFRQDLYQEAVYMSSSMRKLQHSVSPSPDKSNTTMDSPKLDKLKSQSGNSATTSATRSTTTLTEDRQGKDNQSCSNSSKSRQQSSNQIKKTPIKNIHFDNKSLQKRWDHPKRKQEPRVNNQQIADVRSHSAHKNSSEAESPNIISENIVKCLSNILLRMSAVKNPGSASDIRPLWDLKPQNCDEGADFGDPYGIWLEFGKRDIGPYKQLCAIDAKSFNPKRTANTLFLLHRLKLLLRKLASVDLENLNHQEKLAFWINIYNSCMMNTFIENGIQESPEMAVALMRKATINVGGHVLSATTIEHFILRLPYHWRFTFSKGTKNHEMTARSMYGLELSEPLVTFALSCGTWSSPAVRVYTASQVENELEVAKREYLQAAVGISASKFAIPKLLDWYLLNFAKDLESLLDWICLQLPSELGKEAIKFLEERKTESLSQFVQIMPYEFNFRYLICT

SEQ ID NO: 12818 - protein, 525 aa, Glycine max
MQGSLRNANKSGKASSRERKLALQQDVDRLKKQLRHEENIHRALERAFNRPLGALPRLPPYLPPYILALLAEVAVLEEEIVRLEEQVVHFRQDLYQEAVYMSSSMRKLENSVSAPPNKSNPTLDSPKLDKLKSLTQTAEDRQGKENQSCTNSSKSRQQSSNQMNKTPIKNIDSQSLQKRLDHPKRKQEPRVNNQQIADVRNHSPHKNSPEAQSPNIISENILKCLSNILLRMSAVKNPGSTCDMAPLWDLKPQNCDEEADFWDPYGICLEFGKRDIGPYRQLCAIDAKSFNPKRTANTLFLLHRLKLLFRKVASVNLENLNHQEKLAFWINIYNSCMMNAFIENGIPENPQMAVALMRKATINVGGHVLSATTIEHFILRLPYHWKFTFSKGTKNHQMTARSIYGLELSEPLVTFALSSGTWSSPAVRVYTASQVENELEVAKREYLQAAIGFSTSKFAIPKLLDWYLLNFAKDLESLLDWICLQLPSELGKEAIKFLEERKTEPLSQFVQIMPYEFSFRYLICT

SEQ ID NO: 12819 - protein, 542 aa, Glycine max
MHGSLRNANKSRKASSRERKLALQQDVDTLKKKLRHEENIHRALERAFNRPLGALPRLPPYLPPYIPALLAEVAVLEEEIVRLEEQVVHFRQDLYQEAVYMSSSMRKLENSVSAPPNKSNPTMDSPKLDKLKSLTQTTGNSTATSATKPTTTLPDDNRQGKENQSCTNSSKSRKQSSNQTNKTPIKKINNQSLQKKLDHPKRKKEPKVKNQQVADVRNHSPHKNSPEAQSPNIISENILKCLSNIILRMSALKNPGSTCDMPPVWDLKPHNRDEGTEFGDPYGICLEFGKRDIGPYKQLWSIDVKSFNPKRTANTLFLLHRLKLLFRKLASVNLENLNHQEKLAFWINIYNSCMMNAFIENGIPENPQMAVALMRKATINVGGHVLSATTIEHFILRLPYHWRFTFSKGTKNHEMKARSIYGMELSEPLVTFALSSGTWSSPAVRVYTASQVENELEVAKREYLQAAIGFSTSKFAIPKLLDWYLLNFAKDLESLLDWICLQLPSELGKEALKFLEERKTEPLSQFVQIMPYEFSFRYLICT

SEQ ID NO: 12820 - protein, 280 aa, Vigna unguiculata
MIRRRLSVLSTSIIRSSTHSKPILRCPSIQFQPFQLPHSPNAHRKISCYEFPDFQGFRAYSLLSLNDLRDKVPRKQPTRKGRGIGSGKGKTAGRGHKGQRARKGIKLGFEGGQTPLRRRVPKRGFKNPFSLTFQPIGLGKIAKFINAGKIDSSELITMKTLKDAGVLGKQSKDGVRLMGRGSEQIKWPIHLEVSRVTVRAKEAVEAAGGSVRRVYYNKLGLRALLKPEWFEKKGRLLPKAARPPPKQKDKVDSIGRLPAPTKPIPFLVETTKDLPVQPFS

SEQ ID NO: 12821 - protein, 280 aa, Glycine max
MLRRRLSVLSTSIIRRSNHSKPILRYPSIQSHPFQLRHSPSAYRIISPNAFPDFQGFRAYSLLSLNDLRDKVPRKQPTRKGRGIGSGKGKTAGRGHKGQRARKGIKLGFEGGQTPLRRRLPKRGFKNPFSLTFQPIGLGKIAKFINAGKIDSSELITMKTLKDAGVLGKQMKDGVRLMGRGSEQIKWPIHLEVSRVTVRAKEAVEAAGGSVRRVYYNKLGLKALVKPEWFEKKGRLLPRAARPPPKQKDKVDSIGRLPAPTKPIPFLVEASKDLPVQHLS

SEQ ID NO: 12822 - protein, 280 aa, Glycine max
MLRRRLSVLSTSITRSSNYSKPSLGYPSIQSHPFQLPHSPSAYQIISPNAFPDFQGFRAYSLLSLNDLRDKVPRKQPTRKGRGIGSGKGKTAGRGHKGQRARKGIKLGFEGGQTPLRRRLPKRGFKNPFSLTFQPIGLGKIAKFINAGKIDSSELITMKTLKDAGVLGKQMKDGVRLMGRGSEQIKWPIHLEVSRVTVRAKEAVEAAGGSVRRVYYNKLGLKALVKPEWFEKKGRLLPKAARPPPKQKDKVDSIGRLPAPTKPFPFLVEASKDLPVQHLS

SEQ ID NO: 12823 - protein, 278 aa, Cajanus cajan
MLRRRLCGVSTSIIRSSNYSKPIFRYPCIQFHPFQLPHSPNATVRPSSFKGFEGFRAYSLLSLNDLRDRVPRKQPTRKGRGIGSGKGKTAGRGHKGQRARKGIKLGFEGGQTPLRRRVPKRGFKNPFSLTFQPIGLGRIAKLINAGKIDSSELITMKTLKDAGALGKQMKDGVRLMGRGSEQIKWPIHLEVSRVTVRAKEAVEAAGGSVRRVYYNKLGLRALLKPEWFEKKGRLLPKAARPPPKQKDKVDSIGRLPAPTKPIPFLVEANKDLPIQHLS

SEQ ID NO: 12824 - protein, 280 aa, Medicago truncatula
MLRRRLSVLSTSIIRSSTHNKSILGYPSIQFHPLQLPHSLNVFATFNPNARPDFQGFRAYSLLALNDLRDNVPRKQKTRKGRGIGSGKGKTAGRGHKGQRARKGSKLGFEGGQTPLRRRMPKRGFKNPFSLTFQPIGLGKIATFINAGKIDSSELITMKTLKDAGVLGKQIKDGVRLMGRGSEKIQWPIHLEVTRVTVRAKEAVEAAGGSVRKVYYNKLGFQALLKPEWFEKKGRLLPKAARPPPKQKDKVDSIGRLPAPKKPIPFLVEGSKDLLVGQLS

SEQ ID NO: 12825 - protein, 277 aa, Cicer arietinum
MLRRRLSVLSTSIIRSSIYNRYPAVQFQPLQLPQPLNLHATFSNLNAHTNFQGFRAYSLLSLNDLRDNVPRKQKTRKGRGIGSGKGKTAGRGHKGQRARKGSKLGFEGGQTPLRRRMPKRGFKNPFSLTFQPIGLGKIATFINAGKIDSSELITMKTLKDAGVLGKQMKDGVRLMGRGSEKIQWPIHLEVSRVTVRAKEAVEAAGGSVRKVYYNKLGFRALLKPEWFEKKGRLLPKAARPPPKQKDKVDSIGRLPAPTKPIPFLVEASKDLPVNQLS

SEQ ID NO: 12826 - protein, 280 aa, Medicago truncatula
MLRRRLSVLSASIIRSSTHNKSVFGYPSIQFHPLQLPHSLNVRATFNPNAHPDFQGFRAYSLLALNDLRDNVPRKQKTRKGRGIGSGKGKTAGRGHKGQRARKGSKLGFEGGQTPLRRRMPKRGFKNPFSLTFQPIGLGKIATFINAGKIDSSELITMKTLKDAGVLGKQIKDGVRLMGRGSEKIQWPIHLEVTRVTVRAKEAVEAAGGSVRKVYYNKLGFRALLKPEWFEKKGRLLPKAARPPPKQKDRVDSIGRLPAPKKPIPFLVEGIKDLPVGQLS

SEQ ID NO: 12827 - protein, 277 aa, Cicer arietinum
MLRRRLSVLSTSIIRSSIYNRYPAVQFQPLQLPQPLDVRATFSNLNAHTNFQGFRAYSLLSLNDLRDNVPRKQKTRKGRGIGSGKGKTAGRGHKGQRARKGSKLGFEGGQTPLRRRMPKRGFKNPFSLTFQPIGLGKIATFINAGKIDSSELITMKTLKDAGVLGKQIKDGVRLMGRGSEKIQWPIHLEVSRVTVRAKEAVEAAGGSVRKVYYNKLGFRALLKPEWFEKKGRLLPKAARPPPKQKDKVDSIGRLPAPTKPIPFLVETSKDLPVNQLS

SEQ ID NO: 12828 - protein, 284 aa, Medicago truncatula
MLRKRLSVLSTSIIRSSTHNKSVLGYPSIQFHPLQLPHSLNVHATFNPNAHPDFQGFRAYSLLALNDLRDNVPRKQKTRKGRGIGSGKGKTAGRGHKGQRARKGSKLGFEGGQTPLRRRMPKRGFKNPFSLTFQPIGLGKIATFINAGKIDSSELITMKTLKDAGVLGKQIKDGVRLMGRGSEKIQWPIHLEVTRVTVRAKEAVEAAGGSVRKVYYNKLGFRALLKPEWFEKKGRLLPKAARPPPKQKDKVDSIGRLPAPKKPIPFLVEGSNDLPLAVAPLDHS

SEQ ID NO: 12829 - protein, 280 aa, Lupinus angustifolius
MLSRRLAVLSTSVIRSSIRSKPILTFPSVQFHPSQLPHSSNSDATFIPNAFVDSLGFRAYSLLSLNDLRDNIPRKKPTRKGRGIGSGKGKTAGRGHKGQRARKGSKLGFEGGQTPLRRRMPKRGFKNPFSLTFQPVGLGKIAWLINAGKIDSSELITMKTLKDTGAIGKQIKDGVRLMGRGAEQIQWPIHLEVSRVTVRAKAAVEAAGGSVRRVYYNKLGFQALLKPEWFEKKGRLLPKAARPPPKQKDKVDSIGRLPAPTKPIPFLVEGSHDLQVQPLN

SEQ ID NO: 12830 - protein, 278 aa, Lotus japonicus
QRRRLSALSTSIIRSSIHSKPVIRHPSIQLHPVQFPHSRNAYSAFNPNTLQGFQGFRAYSLLMLNDLRDNVPRKQKIRRGRGIGSGKGKTAGFGHKGQRARKGSKLGFEGGQTPLRRRMPKRGFKNPFSLTFQPVGLGKIAKLINAGKIDSSELITMKTLKDSGAIGKQIQDGVRLMGRGSEQILWPIHLEVSRVTVRAKEAVEAAGGSVRKVYYNKLGFKALLKPEWFEKKGRLLPKAARPPPKQKDKVDSIGRLPAPTKPIPFLVEGSKDVPVLSA

SEQ ID NO: 12831 - protein, 281 aa, Arachis hypogaea
MLRRRLTVLSTSIIRSSVWGKPSPTCPLVQFPHPSKLLQYSKSHATLYPKVHPEFQGFRAYSLLALNDLRDNVPRKQKTRKGRGIGSGKGKTAGRGHKGQRARKGSKLGFEGGQTPLRRRMPKRGFKNPFSLTFQPVGLGKIAWLINAGKIDSSELITMKTLKDTGAIGKQIKDGVRLMGRGADQIKWPIHLEVSRVTVRAKEAVEAAGGSVRRVYYNKLGLRALLKPEWFEKKGRLLPKAARPPPKLKDKVDSIGRLPAPTKPIPFLVEGSNDITPPQLS

SEQ ID NO: 12832 - protein, 281 aa, Arachis hypogaea
MLRRRLTVLSTSIIRSSVWGKPSPTCPLVQFPHPSKLLQYSKSHATLYPKVHPEFQGFRAYSLLALNDLRDNVPRKQKTRKGRGIGSGKGKTAGRGHKGQRARKGSKLGFEGGQTPLRRRMPKRGFKNPFSLTFQPVGLGKIAWLINAGKIDSSELITMKTLKDTGAIGKQIKDGVRLMGRGSDQIKWPIHLEVSRVTVRAKEAVEAAGGSVRRVYYNKLGFRALLKPEWFEKKGRLLPKAARPPPKLKDKVDSIGRLPAPTKPIPFLVEGSNDITPPQLS

SEQ ID NO: 12833 - protein, 136 aa, Vigna unguiculata
MASITPLNTMLPNVAPKLPACVAVSNTRVSFAAAPVLPCTSIQRNKSRSSRVVVSAVGDVSADSTVYLVAGAVAVALVGTAFPIFFSRKDTCPECDGAGFVRKADVRLRANAARKDQTQIVCARCNGLGKLNQIDK

SEQ ID NO: 12834 - protein, 207 aa, Vigna unguiculata
MGMKGLVCLMWLSIWVSQSQGRLLSIPSKPDPNNAAATARWLVSLNFWGVLNTISADLGGAPFGNVVSYSDGLPGVGTGIPYFYLTSLDPTARNALKNDKASFTISEYPLGTCGKKDPMNPTCSKISLTGKLKLIDQNSKEAGFARKALFSKHPEMNGWPKDHNFQIFKLEIENIFLIDWFGGPKPLTVEQYLHPKMNDVAFILSAL

SEQ ID NO: 12835 - protein, 105 aa, Vigna unguiculata
MEMKVSRRVNWWRNMMYPLRRVWFSVATRFGFRKNGLLKLRHDVRACEYEDIQVMWEMLNRNESEFGHSSKKSNKNNSNNKKKGHCWKLLNWARCAPYYYMCRRA

SEQ ID NO: 12836 - protein, 103 aa, Glycine max
MEEMEVSRRVEWWQNMMYPVRRVWFVVATRLGIRKNGLLKLRHDVRACEYEDIRVMWEILNRNESEFGHSSSSRKGNNNNNNKKGHCWKLLRWARCAPYMCRA

SEQ ID NO: 12837 - protein, 1114 aa, Glycine max
MDPEVQQSQVAAILGADPSPFQTLISHLMSSSNEQRSHAETLFNLCKQTDPDNLSLKLAHLLHSSPHQEARAMSAILLRKQLTRDDSYLWPRLSPQTQSSLKSLLLSSIQSENIKSISKKLCDTISELASGILPDNAWPELLPFMFQCVSSDSPKLQESAFLIFAQLSQYIGDSLTPHIKHLHDIFLQCLTNATVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFTILMKMLLDIEDDPAWHSAETEDEDAGETSNYSVGQECLDRLSISLGGNTIVPVASEQLPAYLAAPEWQKRHAALIALAQIAEGCSKVMIKNLEQVVAMVLTSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSAALKPDVTITSADSDNDIEDSDDESMETITLGDKRIGIKTSVLEEKATACNMLCCYADELKEGFFPWIDQVAGTLVPLLKFYFHEEVRKAAVSAMPELLRSAKLAIEKGQSQGRDVTYLKFLTDSIIPALVEALHKEPDTEICASMLDSLNECLQISGMLLDESQVRSIVDEIKQVITASSSRKRERAERTQAEDFDAEEGDLIKEENEQEEEVFDQVGEILGTLIKTFKANFLPFFDELSSYLTPMWGRDKTPEERRIAICIFDDVAEQCREAAIKYYDTYLPFLLEACNDETPDVRQAAVYGLGVCAEFGGSVFKPLVGEALLRLNAVIQHPNALHSDNVMAYDNAVSALGKICQFHRDSIDSAQVVPAWLNCLPIKGDLIEAKVVHDQLCSMAERSDSELLGPNNQYLPKIVSVFAEVLCAGKDLATEQTAGRMVNLLRQLQQTLPPSTLASTWSSLQPQQQLALQSILSS

SEQ ID NO: 12838 - protein, 1114 aa, Glycine max
MDSEVQQSQVAAILGADPSPFETLISHLMSSSNEQRSHAEALFNLCKQTDPDSLSLKLAHLLHSSPHEEARAMSAILLRKQLTRDDSYLWPRLSPHTQSSLKSLLLSSIQKENIKSISKKLCDTISELASGILPDNAWPELLPFMFQCVSSDSPKLQESAFLIFAQLSQYIGDSLTPHIKHLHDIFLQCLTNASVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFAILMKMLLDIEDDPAWHSAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSASLKPDVTITSADSDNEIEDSDDESMETITLGDKRIGIKTSVLEEKATACNMLCCYADELKEGFFPWIDQVAGTLVPLLKFYFHEEVRKAAVSAMPELLRSAKLAIEKGQSRGRDVTYLKFLTDSIIPALVEALHKEPDTEICASMLDSLNECLQISGMLLDESQVRSIVDEIKQVITASSSRKRERAERTRAEDFDAEEGELIKEENEQEEEVFDQVGEILGTLIKTFKANFLPFFDELSSYLTPMWGRDKTPEERRIAICIFDDVAEQCREAAVKYYDTYLPFLLEACNDETPDVRQAAVYGLGVCAEFGGSVFKPLVGEALSRLNAVIQHPNALHSDNVMAYDNAVSALGKICQFHRDSIDSAQVVPAWLNCLPIKGDLIEAKVVHDQLCSMAERSDSELLGPNNQYLPKIVSVFAEVLCAGKDLATEQTAGRMVNLLRQLQQTLPPSTLASTWSSLQPQQQLALQSILST

SEQ ID NO: 12839 - protein, 409 aa, Glycine max
MDSEVQQSQVAAILGADPSPFETLISHLMSSSNEQRSHAEALFNLCKQTDPDSLSLKLAHLLHSSPHEEARAMSAILLRKQLTRDDSYLWPRLSPHTQSSLKSLLLSSIQKENIKSISKKLCDTISELASGILPDNAWPELLPFMFQCVSSDSPKLQESAFLIFAQLSQYIGDSLTPHIKHLHDIFLQCLTNASVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFAILMKMLLDIEDDPAWHSAETEDEDAGETSNYSVGQECLDRLSISLGGNTIVPVASEQLPAYLAAPEWQKRHAALIALAQIAEGCSRS

SEQ ID NO: 12840 - protein, 1114 aa, Cajanus cajan
MDPAVQQSQVAAVLGADLSQFETLISHLMSSSNEQRSHAEALFNLCKQTDPDNLSLKLAHILHSSPQQEARAMSAILLRKQLTRDDSYLWPRLSPHTQSSLKSLLLSSIQTENTKSISKKLCDTISELASGILPDNAWPELLPFMFQCVSSDSPKLQESAFLIFAQLSQYIGDSLTPHIKHLHDIFLQCLTNPSVNPDVRIAALNAVINFIQCLSGSADRDRFQDLLPAMMRTLTEALNSGQEATAQEALELLIELAGTEPRFLRRELVDVVGAMLQIAEAESLEEGTRHLAIEFVITLAEARERAPGMMRKLPQFISRLFAILMKMLLDVEDDPAWHSAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVKYHQGVLPALASAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSAALKPDVTITSADSDNDIDDSDDESMETITLGDKRIGIKTSVLEEKATACNMLCCYADELKEGFFPWIDQVAATLVPLLKFYFHEEVRKAAVSAMPELLRSAKLAIEKGLSLGRDVSYLKFLTDTIIPALVEALHKEPDTEICASMLDSLNECLQISGMLLDESQVRSIVDEIKQVITASSSRKRERAERTQAEDFDAEEGELIKEENEQEEEVFDQVGEILGTLIKTFKANFLPFFDELSSYLTPMWGRDKTPEERRIAICIFDDVAEQCREAAIKYYDTFLPFLLEACNDETPDVRQAAVYGLGVCAEFGGSVFKPLVGEALSRLNAVIQHPNALQPDNVMAYDNAVSALGKICQFHRDSIDSAQVVPAWLNCLPIKGDLIEAKVVHDQLCSMAERSDRELLGPNNQYLPKIVSVFAEVLCAGKDLATEQTAGRMINLLRQLQQTLPPSTLASTWSSLQPQQQLALQSILSS

SEQ ID NO: 12841 - protein, 1117 aa, Cicer arietinum
MDPESTQLQQSQLAAILGADPSPFESLISQLMTSSNEERSQAEALFNLCKQTDPDGLVLKLGHLLHSSPHQEARAMSAILLRKQLTRDDSFLWPRLSPHTQSSLKSLLLSSIQTENAKSISKKLCDTISELASSILPDNAWPELLPFMFQCVSSDSPKLQESAFLIFAQLSQYIGDSLTPHIKHLHDIFLQCLTSSVVNPDVRIAALNAVINFIQCLSGSSDRDRFQDLLPAMMRTLTEALNSGQEATAQEALELLIELAGTEPRFLRRQIVDVVGAMLQIAEAESLEEGTRHLAIEFVITLAEARERAPGMMRKMPQFISRLFAILMKMLLDIEDDPAWHTAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVQYHQGVLPALAAAMDDFQNPRVQAHAASAVLNFSENCTPDILTPYLDGIVSKLLVLLQNGKQMVQEGALTALASVADSSQEHFQKYYDAVIPYLKAILVNATDKSNRMLRAKSMECISLVGMAVGKEKFRADAKQVMEVLMSLQVSQMETDDPTTSYMLQAWARLCKCLGQDFLPYMEFVMPPLLQSASLKPDVTITSADSDNEIEDSDDESMETITLGDKRIGIKTSVLEEKATACNMLCCYADELKEGFFPWIDQVAGTLVPLLKFYFHEEVRKAAVSAMPELLRSAKLAIEKGQSQGRDVSYLKFLTDSIIPALVEALHKEPDTEICASMLDSLNECLQISGMLLDEKQVRSIVEEIKQVITASSSRKRERAERAQAEDFDAEEGELIKEENEQEEEVFDQVGEILGTLIKTFKASFLPFFEELSSYLTPMWGRDKTPEERRIAICIFDDVAEQCREAAIKYYDTYLPFLLEACNDETPDVRQAAVYGLGVCAEFGGSVFKPLVGEALSRLNAVIQHPNALHSDNVMAYDNAVSALGKICQFHRDSIDSAQVVPAWLNCLPIKSDLIEAKVVHDQLCSMAERSDSELLGPNNQYLPKIVSVFAEVLCAGKDLATEQTAGRMVTLLRQLQQTLPPATLASTWSSLQPQQQLALQSILSS

SEQ ID NO: 12842 - protein, 1117 aa, Medicago truncatula
MDPESTQLQQSQLAAILGADPSPFETLISHLMSSTNEERSQAEALFNLCKQTDPDALVLKLGHLLHSSPHQEARAMSAILLRKQLTRDDSFLWPRLSSNTQASLKSLLLSSIQSENAKSISKKLCDTISELASSILPDNGWPELLPFMFQCVSSDSAKLQESAFLIFAQLSQYIGDSLTPHIKHLHDIFLQCLTSSAVNPDVRIAALNAVINFIQCLSGSADRDRFQDLLPAMMTTLTEALNSGQEATAQEALELLIELAGTEPRFLRRQIVDVVGAMLQIAEAESLEEGTRHLAIEFVITLAEARERAPGMMRKMPQFISRLFAILMKMLLDIEDDPAWHTADTEDEDAGESSNYSVGQECLDRLSISLGGNTIVPVASEQLPAYLAAPEWQKRHAALIALAQIAEGSSKVMIKTLEQVVAMVLNSFPDQHPRVRWAAINAIGQLSTDLGPDLQVQYHQGVMPALAAAMDDFQNPRVQAHAASAVLNFSENCTPEILTPYLDGIVSKLLVLLQNGKQMVQEGALTALASVADSSQEHFQKYYDAVIPYLKAILVNATDKSNRMLRAKSMECISLVGMAVGKEKFRADAKQVMEVLMSLQGSQMETDDPTTSYMLQAWARLCKCLGQDFLPYMEFVMPPLLQSASLKPDVTITSADSDNDIDDSDDESMETITLGDKRIGIKTSVLEEKATACNMLCCYADELKEGFFPWIDQVAGTLVPLLKFYFHEEVRKAAVSAMPELLRSAKLAIEKGQSQGRDVSYLKFLTDSIIPALVEALHKEPDTEICASMLDSVNECLQISGMLLDEKQVKSIVEEVKQVITASSSRKRERAERAQAEDFDAEEGELIKEENEQEEEVFDQVGEILGTLIKTFKASFLPFFEELSSYLTPMWGRDKTPEERRIAICIFDDVAEQCREGAIKYYDTYLPFLLEACNDETPDVRQAAVYGLGVCAEFGGSVFKPLVGEALSRLNAVIQHPNALHPDNVMAYDNAVSALGKICQFHQDSIDSAQVVPAWLNCLPIKGDLIEAKVVHDQLCSMAERSDSSLLGPNNQYLPKIVAVFAEVLCAGKDLATEQTAGRMVSLLRQLQQTLPPATLASTWSSLQPQQQLALQSILSS

SEQ ID NO: 12843 - protein, 1117 aa, Medicago truncatula
MDPESTQLQQSQLAAILGADPSPFETLISHLMSSTNEERSQAEALFNLCKQTDPDALVLKLGHLLHSSPHQEARAMSAILLRKQLTRDDSFLWPRLSSNTQASLKSLLLSSIQSENAKSISKKLCDTISELASSILPDNGWPELLPFMFQCVSSDSAKLQESAFLIFAQLSQYIGDSLTPHIKHLHDIFLQCLTSSAVNPDVRIAALNAVINFIQCLSGSADRDRFQDLLPAMMTTLTEALNSGQEATAQEALELLIELAGTEPRFLRRQIVDVVGAMLQIAEAESLEEGTRHLAIEFVITLAEARERAPGMMRKMPQFISRLFAILMKMLLDIEDDPAWHTADTEDEDAGESSNYSVGQECLDRLSISLGGNTIVPVASEQLPAYLAAPEWQKRHAALIALAQIAEGSSKVMIKTLEQVVAMVLNSFPDQHPRVRWAAINAIGQLSTDLGPDLQVQYHQGVMPALAAAMDDFQNPRVQAHAASAVLNFSENCTPEILTPYLDGIVSKLLVLLQNGKQMVQEGALTALASVADSSQEHFQKYYDAVIPYLKAILVNATDKSNRMLRAKSMECISLVGMAVGKEKFRADAKQVMEVLMSLQGSQMETDDPTTSYMLQAWARLCKCLGQDFLPYMEFVKPPLLQSASLKPDVTITFADSDNDIDDSDDESMETITLGDKRIGIKTSVLEEKATACNMLCCYADELKEGFFPWIDQVAGTLVPLLKFYFHEEVRKAAVSAMPELLRSAKLAIEKGQSQGRDVSYLKFLTDSIIPALVEALHKEPDTEICASMLDSVNECLQISGMLLDEKQVKSIVEEVKQVITASSSRKRERAERAQAEDFDAEEGELIKEENEQEEEVFDQVGEILGTLIKTFKASFLPFFEELSSYLTPMWGRDKTPEERRIAICIFDDVAEQCREGAIKYYDTYLPFLLEACNDETPDVRQAAVYGLGVCAEFGGSVFKPLVGEALSRLNAVIQHPNALHPDNVMAYDNAVSALGKICQFHQDSIDSAQVVPAWLNCLPIKGDLIEAKVVHDQLCSMAERSDSSLLGPNNQYLPKIVAVFAEVLCAGKDLATEQTAGRMVSLLRQLQQTLPPATLASTWSSLQPQQQLALQSILSS

SEQ ID NO: 12844 - protein, 1116 aa, Citrullus lanatus
MDPQSTQLQQAQLAAILGPDLAPFETLLSHLMSSSNEQRSQAELVFNLCKQTDPDSLSLKLAHLLQFSPQPEARAMSAVLLRKQLTRDDSYLWPRLNPSSQSSLKSILLSCIQREESKSISKKLCDTVSELASGILPDNGWPELLPFMFQCVSSDSPKLQESAFLIFAQLSHYIGDTLVPHIKHLHGVFLQCLTSTSSSTDVKIAALNAVISFIQCLSNSADRDRFQDLLPPMMRTLMEALNNGQEATAQEALELLIELAGTEPRFLRRQLVDVVGSMLQIAEAESLDEGTRHLAIEFVITLAEARERAPGMMRKMPQFISRLFAILMKLLLDIEDDPAWHAAENEDEDAGETSNYSVGQECLDRLAISLGGNTIVPVASELFPAYLAAPEWQNRHAALIAMAQIAEGCSKVMIKNLEQVVAMVLNSFQDPHPRVRWAAINAIGQLSTDLGPDLQVQYHQQVLPALATAMDDFQNPRVQAHAASAVLNFSENCTPDILTPYLDGIVGKLLLLLQNGKQMVQEGALTALASVADSSQEYFQKYYDAVMPYLKAILVNATDKTKRMLRAKSMECISLVGMAVGKEKFRDDAKQVMEVLMSLQGSQMEADDPTTSYMLQAWARLCKCLGQDFLPYMSVVMPPLLQSAQLKPDVTITSADSDNDIEDSDDDSMETITLGDKRIGIKTSVLEEKATACNMLCCYADELKEGFFPWIDQVAPTLVPLLKFYFHEEVRKAAVSAMPELMRSAKLAVEKGLAQGRNETYIKQLSDYIVPALVEALHKEHDTEICSSMLEALNECLQISGPLLDESQVRSIVDEIKQVITASSSRKRERAERAKAEDFDAEEGELIKEENEQEEEVFDQVGEILGTLIKTFKASFLPFFQELSTYLTPMWGKDKTPEERRIAICIFDDVAEQCREAALKYYDTYLPFLLEACNDENPDVRQAAVYGLGVCAEFGGSVFKPLVGEALSRLNVVLRHPNALQPENVMAYDNAVSALGKICQFHRDSIDSAQVVPAWLNCLPIKGDLVEAKIVHDQLCSLVERSDMELLGPNNQYLPKIVAVFAEVLCAGKDLATEQTASRMINLLRQMQQNLPPSTLASTWSSLQPQQQLALQSILS

SEQ ID NO: 12845 - protein, 1115 aa, Manihot esculenta
MDDSTQQLQQAQLAAILGQDPAPFETLISSLMSSSNEQRSQAELAFNLCKQTDPDSLSLKLAHLLQFSPHAEARAMAAVLLRKLLTRDDAYLWPRLSPATQSSIKSILLTCIQHDQTKSIVKKLCDTVSELASGILPENGWPELLPFMFQCVSSDSPKLQESAFFIFAQLSQYIGETLVPFIKELHSVFLQCLGSSPNFDVKIAALNAVINFIQCLSSSSDRDRFQDLLPAMMSTLTEALNNGNEATAQEALELLIELAGTEPRFLRRQLVDVVGSMLQIAEAESLEEGTRHLAIEFVITLAEARERAPGMMRKLPQFISRLFAILMRMLLDVEDDPAWHSAETEDEDAGETSNYSVGQECLDRLAISLGGNTIVPVASEQLPAYLAAPEWQKHHAALIALAQIAEGCSKVMIKNLEQIVSMVLNSFHDPHPRVRWAAINAIGQLSTDLGPDLQNQYHQRVLPALASAMDDFPNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKDKFREDAKQVMEVLMSLQGSQMETDDPTTSYMLQAWARLCKCLGQDFLPYMTVVMPPLLQSAQLKPDVTITSADSDNDIDDSDDESMETITLGDKRIGIKTSVLEEKATACNMLCCYADELKEGFFPWIDQVAPTLVPLLKFYFHEEVRKAAVSAMPELLRSAKLAVEKGLSQGRNESYVKQLSDYIIPALVEALHKEPDTEICANMLDALNECLQISGPLVDEGQVRSIVAEIKQVITASSSRKRERAERTKAEDFDAEEGELIKEENEQEEEVFDQVGEILGTLIKTFKVSFLPFFDELSTYLTPMWGKDKTPEERRIAICIFDDVAEQCRETALKYYDTYLPFLLEACNDDNPDVRQAAVYGLGVCAEFGRSVFKPLVGEALSRLNVVIGHPNAKQPENVMAYDNAVSALGKICQFHRESIDSTQVVPAWLNCLPITGDLIEAKVVHEQLCSMVERSDSELLGPNNQYLPKIVSVFAEVLCGKDLATEQTASRMVNLLRHLQQTLPPATLASTWSMLHPQQQMALQSILSS

SEQ ID NO: 12846 - protein, 1115 aa, Prunus persica
MADSTQLQHAQLATILGPDPAPFQTLISHLMSSSNEQRSQAELLFNLCKQTDPDSLSLKLAHLLQFSPAPEARAMSAILLRKQLTRDDSYLWPRLSPTTQSNLKTILLTCIQREDTKSISKKLCDTISELASGILPDNAWPELLPFMFQCVSSDSPKLQESAFLIFAQLSQYIGDTLVPHIKELHSVFLHSLGNSSSAEVKIAALNAVINFIQCLTSSADRDRFQDLLPAMMRTLMEALNNGNEATAQEALELLIELAGTEPRFLRRQIVEVVGSMLQIAEAESLEEGTRHLAIEFVITLAEARERAPGMMRKLPQFISRLFAILMSMLLDIQDDPAWNTAETEDEEAGETSNYSVGQECLDRLAISLGGNTIVPVASEQLPAYLAAPEWQKHHAALIALAQIAEGCAKVMIKNLEQVVAMVLNSFQDPHPRVRWAAINAIGQLSTDLGPDLQVQYHQQVLPALAAAMDDFQNPRVQAHAASAVLNFSENCTPDILTPYLDGVVSKLLVLLQNGKQMVQEGALTALASVADSSQEHFQKYYDAVMPYLKAILMNATDKSNRMLRAKSMECISLVGMAVGKDKFRDDAKQVMEVLMALQGSQMETDDPTTSYMLQAWARLCKCLGQDFLPYMSVVMPPLLQSAQLKPDVTITSADDNSDIDDSDDESMETITLGDKRIGIKTSVLEEKATACNMLCCYADELKEGFFPWIDQVAPTLVPLLKFYFHEEVRKAAVSAMPELLLSAKLAIEKGQAQGRNETYIKQLSDYIVPALVEALHKEPDTEICANILDALNECLQISGPLLDESQVRSIVEEIKLVITASSSRKRERAERTKAEDFDAEEGELIKEENEQEEEVFDQVGEILGTLIKTFKASFLPFFDELSSYLTPMWAKDKTPEERRIAICIFDDVAEQCREAAVKYYDTFLPFLLEACNDDNPDVRQAAVYGLGVCSEFGGTVIKPLIGEALSRLNVVIQHPNAVQPENLMAYDNAVSALGKICQFHRDSIDAAQVIPAWLNCLPIKGDLIEAKVVHDQLCSMVERSDRELLGPNNQYLPKIVAVFAEVLCAGKDLATEQTTSRMINLLRQLQQTLPPATLASTWSSLQPQQQLALQSILSS

SEQ ID NO: 12847 - protein, 1109 aa, Gossypium raimondii
MDQQSQLALILGPDPIPFETLVSHLMSSSNEQRSHAEALFNLCKQSDPDALCLRLAHLLQVCTQPEIRAMAAILLRKLLTRDDSYIWPRLNISTQSSLKSVLLSQIQVETTKNLSKKLCDTVAELASSILPENGWPELLPFMFQCVSSDSPKLQESAFLIFAQLSQYIGDVLTPFIKDLHTVFLRCLSESSNADVKIAALNAVINFIQCLTSSSDRDRFQDLLPAMMRTLTEALNNGNEATAQEALELLIELAGTEPRFLRRQLVDVVGSMLQIAEAESLEEGTRHLAIEFVVTLAEARERAPGMMRKLPQFISRLFAILMRMLLDIEDDAAWHTAESEDEDAGETSNYSVGQECLDRLAISLGGNTIVPVASEQLPAYLAASEWQKHHAALIALAQIAEGCAKVMIKNLEQVVSMVLNSFHDSHPRVRWAAINAIGQLSTDLGPDLQNQYHQRVLPALAGAMDDFQNPRVQAHAASAVLNFSENCTPEILTPYLDGIVSKLLVLLQNGKQMVQEGALTALASVADSSQEHFQKYYDAVMPYLKAILVNATDKSNRMLRAKSLECISLVGMAVGKEKFRDDAKQVMEVLMSLQGSQMETDDPTTSYMLQAWARLCKCLGQDFLPYMSVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDYIIPALVEALHKEPDTEICASMLDALNECIQISGPLLDESQVRSIVDEIKQVITASASRKRERAERAKAEDFDAEEGELIKEENEQEEEVFDQVGEILGTLVKTFKASFLPFFDELSSYLTPMWGKDKTAEERRIAICIFDDVAEQCREAAIKYYDTYLPFILEACNDENPDVRQAAVYGLGVCTEFGGPVFKPLVGEALSRLNAVIRHPNALQPENVMAYDNAVSALGKICLFHRDSIDAAQIVPAWLNCLPIKGDLIEAKVVHEQLCSMVERSDSEVLGPNHQYLPKIVAVFAEVLCGKDLATEQTASRMLNLLRQLQQTLPAATLASTWSSLQPQQQLALQSMLSS

SEQ ID NO: 12848 - protein, 1109 aa, Gossypium hirsutum
MDQQSQLALILGPDPIPFETLVSHLMSSSNEQRSHAEALFNLCKQSDPDALCLRLAHLLQVCTQPETRAMAAILLRKLLTRDDSYIWPRLNISTQSSLKSVILSQIQVETTKNLSKKLCDTVAELASSILPENGWPELLPFMFQCVSSDSPKLQESAFLIFAQLSQYIGDVLTPFIKDLHTVFLRCLSESSNADVKIAALNAVINFIQCLTSSSDRDRFQDLLPAMMRTLTEALNNGNEATAQEALELLIELAGTEPRFLRRQLVDVVGSMLQIAEAESLEEGTRHLAIEFVVTLAEARERAPGMMRKLPQFISRLFAILMRMLLDIEDDAAWHTAESEDEDAGETSNYSVGQECLDRLAISLGGNTIVPVASEQLPAYLAASEWQKHHAALIALAQIAEGCAKVMIKNLEQVVSMVLNSFHDSHPRVRWAAINAIGQLSTDLGPDLQNQYHQRVLPALAGAMDDFQNPRVQAHAASAVLNFSENCTPEILTPYLDGIVSKLLVLLQNGKQMVQEGALTALASVADSSQEHFQKYYDAVMPYLKAILVNATDKSNRMLRAKSLECISLVGMAVGKEKFRDDAKQVMEVLMSLQGSQMETDDPTTSYMLQAWARLCKCLGQDFLPYMSVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDYIIPALVEALHKEPDTEICASMLDALNECIQISGLLLDESQVRSIVDEIKQVITASASRKRERAERAKAEDFDAEEGELIKEENEQEEEVFDQVGEILGTLVKTFKASFLPFFDELSSYLTPMWGKDKTAEERRIAICIFDDVAEQCREAAIKYYDTYLPFILEACNDENPDVRQAAVYGLGVCTEFGGPVFKPLVGEALSRLNAVIRHPNALQPENVMAYDNAVSALGKICLFHRDSIDAAQIVPAWLNCLPIKGDLIEAKVVHEQLCSMVERSDSEVLGPNHQYLPKIVAVFAEVLCGKDLATEQTASRMLNLLRQLQQTLPAATLASTWSSLQPQQQLALQSMLSS

SEQ ID NO: 12849 - protein, 1115 aa, Prunus mume
MADSTQLQHAQLATILGPDPAPFQTLISHLMSSSNEQRSQAELLFNLCKQTDPDSLSLKLAHLLQFSPAPEARAMSAILLRKQLTRDDSYLWPRLSPATQSNLKTILLTCIQREDTKSISKKLCDTISELASGILPDNAWPELLPFMFQCVSSNSPKLQESAFLIFAQLSQYIGDTLVPHIKELHAVFLHSLGNSSSAEVKIAALNAVINFIQCLTSSADRDRFQDLLPAMMRTLMEALNNGNEATAQEALELLIELAGTEPRFLRRQIVEVVGSMLQIAEAESLEEGTRHLAIEFVITLAEARERAPGMMRKLPQFISRLFAILMSMLLDIQDDPAWNTAETEDEEAGETSNYSVGQECLDRLAISLGGNTIVPVASEQLPAYLAAPEWQKHHAALIALAQIAEGCAKVMIKNLEQVVAMVLNSFQDPHPRVRWAAINAIGQLSTDLGPDLQVQYHQQVLPALAAAMDDFQNPRVQAHAASAVLNFSENCTPDILTPYLDGVVSKLLVLLQNGKQMVQEGALTALASVADSSQEHFQKYYDAVMPYLKAILMNATDKSNRMLRAKSMECISLVGMAVGKDKFRDDAKQVMEVLMALQGSQMETDDPTTSYMLQAWARLCKCLGQDFLPYMSVVMPPLLLSAQLKPDVTITSADDNSDVDDSDDESMETITLGDKRIGIKTSVLEEKATACNMLCCYADELKEGFFPWIDQVAPTLVPLLKFYFHEEVRKAAVSAMPELLLSAKLAIEKGQAQGRNETYIKQLSDYIVPALVEALHKEPDTEICANILDALNECLQISGPLLDESQVRSIVEEIKLVITASSSRKRERAERTKAEDFDAEEGELIKEENEQEEEVFDQVGEILGTLIKTFKASFLPFFDELSSYLTPMWAKDKTPEERRIAICIFDDVAEQCREAAVKYYDTFLPFLLEACNDDNPDVRQAAVYGLGVCSEFGGTVIKPLIGEALSRLNVVIQHPNAVQPENLMAYDNAVSALGKICQFHRDSIDAAQVIPAWLNCLPIKGDLIEAKVVHDQLCSMVERSDRELLGPNNQYLSKIVAVFAEVLCAGKDLATEQTASRMINLLRQLQQTLPPATLASTWSSLQPQQQLALQSILSS

SEQ ID NO: 12850 - protein, 1115 aa, Malus domestica
MAESTHLQQAQLATILGPDPAPFQTLISHLMSSANEQRSQAELLFNLCKQTDPDSLSLKLAHLLQFCPAAEARAMSAILLRKQLTRDDSYLWPRLNPTTQSTLKTILLTCIQQEDTKSISKKLCDTISELASGILPDNGWPELLPFMFQCVSSDSPKLQEAAFLIFAQLSQYIGDTMVPHIKELHAVFLHSLGNSPSPDVKIAALNAVINFIQCLTSSADRDRFQDLLPAMMKTLMEALNNGNEATAQDALELLIELAGTEPRFLRRQIVEVVGAMLQIAEADSLEEATRHLAIEFVITLAEARERAPGMMRKLPQFISRLFSILMKMLLDIEDEPAWHAAESEDEDAGETGNYSVGQECLDRLAISLGGNTIVPVASEQLPAYLAAPEWQKHHAALIALAQIAEGCAKVMIKNLEQVVAMVLNSFQDPHPRVRWAAINAIGQLSTDLGPDLQVQYHQRVLPALAGAMDDFQNPRVQAHAASAVLNFSENCTPDILTPYLDGVVSKLLVLLQNGKQMVQEGALTALASVADSSQEHFQKYYDAVMPYLKAILVNATDKSNRMLRAKSMECISLVGMAVGKEKFREDAKQVMEVLMALQGSHMETDDPTTSYMLQAWARLCKCLGQDFLPYMSVVMPPLLQSAQLKPDVTITSADDENDIDDSDDDSMETITLGDKRIGIKTSVLEEKATACNMLCCYADELKEGFFPWIDQVAPTLVPLLKFYFHEEVRKAAVSAMPELLRSAKLAIEKGQAQGRNETYIKQLSDYIVPALVEALHKEPDTEICANILDALNECLQTSGPLLDEGQVRSIVEEIKQVITASSSRKRERAERTKAEDFDAEEQELIKEENEQEEEVFDQVGEIIGTLIKTFKASFLPFFDELSSYLTPMWAKDKTPEERRIAICIFDEVAEQCREAAVKYYDTFLPFLLEACNDENPDVRQAAVYGLGICSEFGGAIIKPLVGEALSRLNAVIQHPNAQQSENVMAYDNAVSALGKISQFHRDSIDAAQVIPAWLNCLPIKGDLVEAKVVHDQLCSMVERSDRELLGPNNQYLPKIVAVFAEVLCAGKDLATEQTANRMIKLLRQLQQTLPPATLASTWSSLQPQQQLALQSILSS

SEQ ID NO: 12851 - protein, 1108 aa, Theobroma cacao
MDQQSQLAVILGPDPAPFETLISHLMSSSNEQRSHAEVLFNLCKQSDPDALCLRLAHLLQVCAQPETRAMAAILLRKLLTRDDSYIWPRLNISTQSSLKSVLLAQIQVENTKTLSKKLCDTVAELASSILPENGWPELLPFMFQCVSSDSPRLQESAFLIFAQLSQYIGDVLTPFIKDLHAVFLRCLSESSNADVKIAALNAVINFIQCLTSLSDRDRFQDLLPAMMRTLTEALNNGNEATAQEALELLIELAGTEPRFLRRQLVDVVGSMLQIAEAESLEEGTRHLAIEFVITLAEARERAPGMMRKLPQFISRLFAILMGMLLDIEDDPAWYTAETEDEDAGETSNYSVGQECLDRLAISLGGNTIVPVASEQLPAYLAASEWQKHHAALIALAQIAEGCAKVMIKNLEQVVSMVLNSFHDSHPRVRWAAINAIGQLSTDLGPDLQNQYHQRVLPALAAAMDDFQNPRVQAHAASAVLNFSENCTPEILTPYLDGIVSKLLVLLQNGKQMVQEGALTALASVADSSQEHFQKYYDAVMPYLKTILVNATDKSNRMLRAKSMECISLVGMAVGKEKFRDDAKQVMEVLMSLQGSQMETDDPTTSYMLQAWARLCKCLGQDFLPYMRVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDFIIPALVEALHKEPDTEICASMLDALNECLQITGPLLDEGQVRSIVDEIKQVITASASRKRERAERAKAEDFDAEEGEFVKEENEQEEEVFDQVGEILGTLIKTFKASFLPFFDELSSYLTPMWGKDKTAEERRIAICIFDDIAEQCREAALKYYETYLPFILEACNDENPDVRQAAVYGLGVCAEFGGPVFKPLVGEALSRLNVVIRHPNALQPENVMAYDNAVSALGKICLFHRDRIDAAQVVPAWLNCLPIKGDLIEAKVVHEQLCSMVERSDNEVLGPNHQYLPKIVAVFAEVLCGKDLATEQTASRMVNLLRQLQQTLPPATLASTWSSLQPQQQLALQSILS

SEQ ID NO: 12852 - protein, 1115 aa, Malus domestica
MAESTQLQQAQLATILGPDPAPFQTLISHLMSSANDQRSQAELLFNLCKQTDPDSLSLKLAHLIQFSPAAEARAMSAILLRKQLTRNDSYLWPRLNPTTQSTLKTILLTCIQQEGTKSISKKLCDTISELASGILPDNGWPELLPFMFQCVSSDSPKLQEAAFLIFAQLSQYIGDIMVPHIKELHAVFLHSLGNSPSPDVKIAALNAVINFIQCLTSSADRDRFQDLLPAMMKTLMEALNNGNEATAQDALELLIELAGTEPRFLRRQIVEVVGAMLQIAEADSLEESTRHLAIEFVITLAEARERAPGMMRKLPQFISRLFAILMKMLLDIEDEPAWHAAESEDEDAGETTNYSVGQECLDRLSISLGGNTIVPVASEQLPAYLAAPEWQKHHAALIALAQIAEGCAKVMIKNLEQVVAMVLNSFQDPHPRVRWAAINAIGQLSTDLGPDLQVQYHQSVLPALAGAMDDFQNPRVQAHAASAVLNFSENCTPDILTPYLDGVVSKLLVLLQNGKQMVQEGALTALASVADSSQEHFQKYYDAVMPYLKAILVNATDKSNRMLRAKSMECISLVGMAVGKEKFREDAKQVMEVLMALQGSHMETDDPTTSYMLQAWARLCKCLGQDFLPYMSVVMPPLLQSAQLKPDVTITSADDDNDIDDSDDDSMETITLGDKRIGIKTSVLEEKATACNMLCCYADELKEGFFPWIDQVAPTLVPLLKFYFHEEVRKAAVSAMPELLRSAKLAIEKGQAQGRNETYIKQLSDYIVPALVEALHKEPDTEICANILDALNECLQTSGPLLDESQVKSIVEEIKQVITASASRKRERAERTKAEDFDAEEQELIKEENEQEEEVFDQVGEIIGTLIKTFKASFLPFFDELALYLTPMWAKDKTPEERRIAICIFDEVAEQCREAAVKYYDTFLPFLLEACNDENPDVRQAAVYGLGVCSEFGGAVIKPLVGEALSRLNAVIQHPNAQQSENVMAYDNAISALGKISQFHRDSIDAAQVIPAWLNCLPIKGDLVEAKVVHEQLCSMVERSDRELLGPNNQYLPKIVAVFAEVLCAGKDLATEQTASRMINLLKQLQQTLPPATLASTWSSLQPQQQLALQSILSS

SEQ ID NO: 12853 - protein, 1116 aa, Citrus clementina
MAAESTHLQQSQLAVILGPDSAPFETLISHLMSTSNEQRSEAELLFNLCKQQDPDSLTLKLAHLLQRSPHPEARAMAAVLLRKLLTRDDSFLWPRLSLHTQSSLKSMLLQSIQLESAKSISKKLCDTVSELASNILPENGWPELLPFMFQCVSSDSVKLQESAFLIFAQLSQYIGDTLTPHLKHLHAVFLNCLTNSNNPDVKIAALNAVINFIQCLTSSADRDRFQDLLPLMMRTLTESLNNGNEATAQEALELLIELAGTEPRFLRRQLVDVVGSMLQIAEAESLEEGTRHLAIEFVITLAEARERAPGMMRKLPQFINRLFAILMSMLLDIEDDPLWHSAETEDEDAGESSNYSVGQECLDRLAIALGGNTIVPVASEQLPAYLAAPEWQKHHAALIALAQIAEGCAKVMVKNLEQVLSMVLNSFRDPHPRVRWAAINAIGQLSTDLGPDLQNQFHPQVLPALAGAMDDFQNPRVQAHAASAVLNFSENCTPEILTPYLDGIVSKLLVLLQNGKQMVQEGALTALASVADSSQEHFQKYYDAVMPFLKAILVNATDKSNRMLRAKSMECISLVGMAVGKDKFRDDAKQVMEVLMSLQGSQMETDDPTTSYMLQAWARLCKCLGQDFLPYMSVVMPPLLQSAQLKPDVTITSADSDNEIEDSDDDSMETITLGDKRIGIKTSVLEEKATACNMLCCYADELKEGFFPWIDQVAPTLVPLLKFYFHEEVRKAAVSAMPELLRSAKLAIEKGLAPGRNESYVKQLSDFIIPALVEALHKEPDTEICASMLDSLNECIQISGPLLDEGQVRSIVDEIKQVITASSSRKRERAERAKAEDFDAEESELIKEENEQEEEVFDQVGEILGTLIKTFKAAFLPFFDELSSYLTPMWGKDKTAEERRIAICIFDDVAEQCREAALKYYETYLPFLLEACNDENQDVRQAAVYGLGVCAEFGGSVVKPLVGEALSRLNVVIRHPNALQPENLMAYDNAVSALGKICQFHRDSIDAAQVVPAWLNCLPIKGDLIEAKIVHEQLCSMVERSDSDLLGPNHQYLPKIVSVFAEILCGKDLATEQTLSRIVNLLKQLQQTLPPATLASTWSSLQPQQQLALQSILSLV

SEQ ID NO: 12854 - protein, 1114 aa, Citrus sinensis
MAAESTHLQQSQLAVILGPDSAPFETLISHLMSTSNEQRSEAELLFNLCKQQDPDSLTLKLAHLLQRSPHPEARAMAAVLLRKLLTRDDSFLWPRLSLHTQSSLKSMLLQSIQLESAKSISKKLCDTVSELASNILPENGWPELLPFMFQCVSSDSVKLQESAFLIFAQLSQYIGDTLTPHLKHLHAVFLNCLTNSNNPDVKIAALNAVINFIQCLTSSADRDRFQDLLPLMMRTLTESLNNGNEATAQEALELLIELAGTEPRFLRRQLVDVVGSMLQIAEAESLEEGTRHLAIEFVITLAEARERAPGMMRKLPQFINRLFAILMSMLLDIEDDPLWHSAETEDEDAGESSNYSVGQECLDRLAIALGGNTIVPVASEQLPAYLAAPEWQKHHAALIALAQIAEGCAKVMVKNLEQVLSMVLNSFRDPHPRVRWAAINAIGQLSTDLGPDLQNQFHPQVLPALAGAMDDFQNPRVQAHAASAVLNFSENCTPEILTPYLDGIVSKLLVLLQNGKQMVQEGALTALASVADSSQEHFQKYYDAVMPFLKAILVNATDKSNRMLRAKSMECISLVGMAVGKDKFRDDAKQVMEVLMSLQGSQMETDDPTTSYMLQAWARLCKCLGQDFLPYMSVVMPPLLQSAQLKPDVTITSADSDNEIEDSDDDSMETITLGDKRIGIKTSVLEEKATACNMLCCYADELKEGFFPWIDQVAPTLVPLLKFYFHEEVRKAAVSAMPELLRSAKLAIEKGLAPGRNESYVKQLSDFIIPALVEALHKEPDTEICASMLDSLNECIQISGPLLDEGQVRSIVDEIKQVITASSSRKRERAERAKAEDFDAEESELIKEENEQEEEVFDQVGEILGTLIKTFKAAFLPFFDELSSYLTPMWGKDKTAEERRIAICIFDDVAEQCREAALKYYETYLPFLLEACNDENQDVRQAAVYGLGVCAEFGGSVVKPLVGEALSRLNVVIRHPNALQPENLMAYDNAVSALGKICQFHRDSIDAAQVVPAWLNCLPIKGDLIEAKIVHEQLCSMVERSDSDLLGPNHQYLPKIVSVFAEILCGKDLATEQTLSRIVNLLKQLQQTLPPATLASTWSSLQPQQQLALQSILS

SEQ ID NO: 12855 - protein, 1115 aa, Fragaria vesca
MAESTQLQQAQLATILGPDPAPFETLISHLMASANEQRSQAELLFNLCKQTDPDSLSLKLAHLLQFSPAQEARAMSAILLRKQLTRDDTYLWPRLSPNTQSTLKSILLSCIQREEVKSISKKLCDTISELASGILPENGWPELLPFMFQCVSSDSPKLQESAFLIFAQLSQYIGDSLVPYIKELHTVFLQCLSSSTNSDVKIAALNAVINFIQCLTSSGDRDRFQDLLPAMMRTLMESLNNGNEATAQEALELFIELAGTEPRFLRRQIVEVVGSMLQIAEADSLEEGTRHLAIEFVITLAEARERAPGMMRKLPQFISRLFAILMNMVLDIEDDPSWHTAETEDEDAGESGNYSVGQECLDRLAISLGGNTIVPVASEQLPAYLAAPEWQKHHAALIALAQIAEGCSKVMIKNLEQVVAMVLNSFQDPHPRVRWAAINAIGQLSTDLGPDLQVQYHQRVLPALASAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRDDAKQVMEVLMSLQGSQMETDDPTTSYMLQAWARLCKCLGQDFLPYMSVVMPPLLQSAQLKPDVTITSADDNSDIDDSDDDSMETITLGDKRIGIKTSVLEEKATACNMLCCYADELKEGFFPWIDQVAPTLVPLLKFYFHEEVRKAAVSAMPELLLSAKLAIEKGLAQGRNETYIKQLSDYIVPALVEALHKEPDTEICANILDAINECIQISGPLLDESQVRSIVEEIKQVITASSSRKRERAERTQAEDFDDEERELIKEENEQEEEVFDQVGEILGTLIKTFKASFLPFFDELATYLTPMWGKDKTPEERRIAICIFDDVAEQCREAALKYYDTFLPFLLEACNDESPDVRQAAVYGLGVCAEFGGTVIKPLISVALSRLNVVIQHPNAQQPDNIMAYDNAVSALGKICQYHRDSIDAAQVIPAWLNCLPIKGDLIEAKVVHDQLCSMVERSDGDILGPNNQYLSKIVQVFAEVLCAGKELATEQTASRMINLLKQLQQTLPPQTLASTWSSLQPQQQLALQSILSS

SEQ ID NO: 12856 - protein, 1109 aa, Gossypium raimondii
MDQQSQLAVILGSDPVPFETLISHLMSSSNEQRSHAEALFNVCKQSDPDALCLRLAHLLQVCAQPDTRAMAAILLRKLLTRDDSYIWPRLNVSTHSSIKSVLLNQIQVETAQSLSKKLCDTVSELASSILPENGWPELLPFMFQCVSSDSPRLQESAFLIFAQLSQYIGDVLTPFIKDLHTVFLKCLSENSNADVKIAALNAVINFIQCLTSSSDRDRFQDLLPAMMKTLTEALNNGNEATAQEALELLIELAETEPRFLRRQIVDVVGSMLQIAEAESLEEGTRHLAIEFVVTLAEARERAPGMMRKLPQFISRLFAILMRLLLDIEDDAAWHTAEVEDEDAGETSNYAVGQECLDRLAISLGGNTIVPVASEQFSTYLAAPEWQKHHAALIALAQIAEGCSKVMVKNLEQVVSMVLNSFNHSHPRVRWAAINAIGQLSTDLGPDLQNQYHQRVLPALAAAMDDFQNPRVQAHAASAVLNFSENCTPEILTPYLDGIVSKLLVLLQNGKQMVQEGALTALASVADSSQEHFQKYYDAVMPYLKAILVNATDKSNRMLRAKSMECISLVGMAVGKEKFRDDAKQVMEVLMSLQGSQMETDDPTTSYMLQAWARLCKCLGQDFLPYMSVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDYIIPALVEALHKEPDTEICASMLDALNECVQISGPLLDESQVRSIVDEIKQVITASASRKSERAERAKAEDFDAEEGELIKEENEQEEEVFDQVGEILGTLIKTFKASFLPFFDELSSYLTPMWGKDKTPEERRIAICIFDDVAEQCREAALKYYDTYLPFILEACNDENPDVRQAAVYGLGVCAEFGGPVFKPLVGEALSRLNAVIRHPNASQPENVMAYDNAVSALGKICLFHRDSIDATQVVPAWLNCLPIKGDLIEAKVVHEQLCSMVERSDNEVLGPNHHFLPKIVSVFAEVLCGKDLATEQTASRMVNLLRQLQQTLPPAALASTLSSLQPQQQLALQSILSS

SEQ ID NO: 12857 - protein, 1109 aa, Gossypium raimondii
MDQQSQLAVILGSDPVPFETLISHLMSSSNEQRSHAEALFNVCKQSDPDALCLRLAHLLQVCAQPDTRAMAAILLRKLLTRDDSYIWPRLNVSTHSSIKSVLLNQIQVETAQSLSKKLCDTVSELASSILPENGWPELLPFMFQCVSSDSPRLQESAFLIFAQLSQYIGDVLTPFIKDLHTVFLKCLSGNSNADVKIAALNAVINFIQCLTSSSDRDRFQDLLPAMMKTLTEALNNGNEATAQEALELLIELAETEPRFLRRQIVDVVGSMLQIAEAESLEEGTRHLAIEFVVTLAEARERAPGMMRKLPQFISRLFAILMRLLLDIEDDAAWHTAEVEDEDAGETSNYAVGQECLDRLAISLGGNTIVPVASEQFSTYLAAPEWQKHHAALIALAQIAEGCSKVMVKNLEQVVSMVLNSFNHSHPRVRWAAINAIGQLSTDLGPDLQNQYHQRVLPALAAAMDDFQNPRVQAHAASAVLNFSENCTPEILTPYLDGIVSKLLVLLQNGKQMVQEGALTALASVADSSQEHFQKYYDAVMPYLKAILVNATDKSNRMLRAKSMECISLVGMAVGKEKFRDDAKQVMEVLMSLQVSQMETDDPTTSYMLQAWARLCKCLGQDFLPYMSVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDYVIPALVEALHKEPDTEICASMLDALNECVQISGPLLDESQVRSIVDEIKQVITASASRKSERAERAKAEDFDAEEGELIKEENEQEEEVFDQVGEILGTLIKTFKASFLPFFDELSSYLTPMWGKDKTPEERRIAICIFDDVAEQCREAALKYYDTYLPFILEACNDENPDVRQAAVYGLGVCAEFGGPVFKPLVGEALSRLNAVIRHPNASQPENVMAYDNAVSALGKICLFHRDSIDATQVVPAWLNCLPIKGDLIEAKVVHEQLCSMVERSDNEVLGPNHNFLPKIVSVFAEVLCGKDLATEQTASRMVNLLRQLQQTLPPAALASTLSSLQPQQQLALQSILSS

SEQ ID NO: 12858 - protein, 1116 aa, Aquilegia formosa
MDSDSTQLQQAQLAAILGPDPSSFETLVSHLMSSGNEQRSQAEVLFNLCKQNHPDALSLKLVHLLESSSHVEIRAMSAILLRKQLTRDDSYIWPRLSPSTQTALKSHLLVCVQREDTKSITKKLCDTVSELASGILPDGGWPELLPFMFQCVTSDSPKLQESALLMFAQLSQYIGETLIPHLNTLHSVFFQCLSSSSNADVRIASLGASINFIQCLSSASDRDKFQDLLPSMMQTLTEALNSGQESIAQEALELLIELAGTEPKFLRRQLVDVVGSMLQIAEAESLEEGTRHLAIEFVITLAEARERAPGMMRKLPQFISRLFAILMKMLLDIEDDAAWHTADSEDEDAGESSNYSVGQECLDRLSISLGGNTIVPVASEVLPAYLAAPEWQKHHAALIALAQIAEGCSKVMTKNLEQVVIMVLNSFQDPHPRVRWAAINAVGQLSTDLGPDLQVQYHQQVLPALALAMDDFQNPRVQAHAASAVLNFSENCTPDILTPYLDGIVSKLLVLLQNGKQMVQEGALTALASVADSSQEHFQKYYDSVMPYLKAILMNATDKSNRMLRAKSMECISLVGMAVGKDKFRDDAKQVMEVLMTLQGSQMETDDPTTSYMLQAWARLCKCLGQDFLPYMSVVMPPLLQSAQLKPDVTITSADSDADIDVSDDESIETITLGDKRIGIKTSVLEEKATACNMLCCYADELKEGFYPWIDQVAPTLVPLLKFYFHEEVRKAAVSAMPELLRSAKLAIEKGQAPGRNESYIKQLSDYIIPALVEALHKEPETEICASMLDALNECVQVSGPLLDESQVRCIVDEIKQVITASSTRKRERAERAKAEDFDAEEGELLKEENEQEEEVFDQVGDCLGTLIKTFKASFLPFFDELSSYITPMWGKDKTAEERRIAICIFDDVAEQCREAALKYYDTYLPFLLEACNDENPDVRQAAVYGIGVCAEFGGTVFRPLVGEALSRLNIVIRHPNALHADNLMAYDNAVSALGKICQFHRDSIDAAQVVPAWLSCLPIKGDLIEAKLVHDQLCSMVERSDGELLGPNNQYLPKIVAVFAEVLCAGKDLATEQTASRMINLLRQLQQTLPPSTLASTWSSLQPQQQLALQSILSS

SEQ ID NO: 12859 - protein, 1084 aa, Manihot esculenta
MDDSTQQLQQAQLAAILGQDPTPFEALISSLMSSSNEQRSQAELAFNLCKQTDPDSLSLKLAHLLQFSSHAEARAMSAVLLRKLLTRDDAYLWPRLSLAAQSSIKSILLTCIQHEQTKSIVKKLCDTVSELASGILPENGWPELLPFMFQCVSSDSPKLQESAFLIFAQLSQYIGETLIPFIKELHSVFLQCLGSSSNFDVKIAALNAVINFIQCLNSSSDRDRFQDLLPAMIRTLTEALNNGNEATAQEALELLIELAGSEPRFLRRQLVDVVGSMLQIAEAESLEEGTRHLAIEFVITLAEARERAPGMMRKLPQFISRLFAILMRMLLDIEDDPAWHSAESEDEDAGETGNYSVGQECLDRLAISLGGNTIVPVASEQLPAYLAAPEWQKHHAALIALAQIAEGCSKVMIKNLEQVVSMVLNSFYDPHPRVRWAAINAIGQLSTDLGPDLQNQYHQRVLPALASAMDDFPNPRVQAHAASAVLNFSENCTPEILTPYLDGIVSKLLVLLQNGKQMVQEGALTALASVADSSQEHFQKYYDAVMPYLKAILVNATDKSNRMLRAKSMECISLVGMAVGKDKFREDAKQVMEVLMSLQGSQMEADDPTTSYMLQPDVTITSADSDNDIDDSDDESMETITLGDKRIAIKTSVLEEKATACNMLCCYADELKEGFFPWIDQVATTLVPLLKFYFHEEVRKAAVSAMPELLRSAKLAVEKGLSQGRNESYVKQLSDYIIPALVEALHKEPDTEICANMLDALNECLQISGPLVDEGQVKSIIDEIKQVITASSSRKRERAERAKAEDFDAEEGELIKEENEQEEEVFDQVGEILGTLIKTFKASFLPFFDELSTYLTPMWGKDKTAEERRIAICIFDDVAEQCHEAALKYYDTYLPFLLEACNDENPDVRQAAVYGLGVCAEFGVSVFKPLVGEALSRLNVVIQHPNAKHPENVMAYDNAVSALGKICQFHRASIDSAQVVPAWLNCLPITGDLIEAKVVHEQLCLMVERSDSELLGPNNQYLPKIVSVFAEVVCGKDLATEQTASRMVNLLRHLQQTLPPATLASTWSLLHPQQQMALQSILSS

SEQ ID NO: 12860 - protein, 1116 aa, Vitis vinifera
MASDPTPLQLNQIAAILGPDPVHFEALISHLMATANDQRSQAEALFNLCKQTHPDSLVLKLAILLQSSPHPEARAMAAILLRKQLTRDDSYLWPNLSATTQANLKSILLDCVQRETAKTISKKLCDTVSELASGILPDGGWPELLPFMFQCVTSSNFKLQEAALLIFAQLSQYIGETLLPHLDTLHSVFLQSLASSMNSDVRIAALGAAINFIQCLSNAAERDKFQDLLPLMMQTLTEALNSSQEATAQEALELLIELAGTEPRFLRRQLVEVVGSMLQIAEAELLEEGTRHLAVEFVITLAEARERAPGMIRKLPQFIQRLFAILMKMLLDIEDDPVWHSAEEEHEDAGETSNYSVGQECLDRLSISLGGNTIVPVASELLPAYLAAPEWQKHHAALIALAQIAEGCSKVMIKNLEQIVSMVLNSFQDPHPRVRWAAINAIGQLSTDLGPELQVKYHQRLLPALAAAMDDFQNPRVQAHAASAVLNFSENCTPDILTPYLDGIVSKLLVLLQNGKQMVQEGALTALASVADSSQVHFQKYYDAVMPYLKAILVNANDKSNRMLRAKSMECISLVGMAVGKEKFRDDAKQVMDVLMSLQGSQMEADDPTTSYMLQAWARLCKCLGQDFLPYMNVVMPPLLQSAQLKPDVTITSADSDADIYDSDDDSIETITLGDKRIGIKTSVLEEKATACNMLCCYADELKEGFFPWIDQVAPTLVPLLKFYFHEEVRKAAVSAMPELLRSAKLAVEKGQSQGRNESYIKQLSDYIIPALVDALHKEPETEICASMLDSLNECIQISGPLLDEGQVRSIVDEIKQVITASSSRKRERAERAKAEDFDAEEGELLKEENEQEEELFDQIGDCLGTLIKTFKSSFLPFFDELSSYLMPMWGKDKTAEERRIAICIFDDVAEQCRESALKYYDTYLPFLLEACNDENPHVRQAAVYGIGVCAEFGGSAFKPLVGEALSRLDVVIRHSNARDSDNVMAYDNAVSALGKICQFHRDSIDAVQIVPAWLSCLPLKGDLIEAKVVHDQLCSMVERSDRELLGPNNQYLPKIVAVFAEVLCAGKDLATEETTSRMINLLRQLRQTLSPSALASTWSSLQPQQQLALQSILST

SEQ ID NO: 12861 - protein, 1114 aa, Cucumis sativus
MAAADPTQLHQLSLLLGSDRTHFETLISHLMSSSNDQRSQAESLFNLCKQAHPDALALKLADLLHPSAHPEARTMSAILLRRQLIRDDSYLWPRLSPSTQSTLKSVLLSSLQTEESKSISKKLCDTIAELASGILPDGGWNELMPFIFQCVTSDSSKLQESALLIFAQLAQYIGETLVPHLDTLHSVFSQCLASSKTGDVRIAALGAAINFIQCLSSASDRDRFQNLLPLMMQTLTEALNSGQEATAKDALELLIELAGTEPRFLRRQLVDVVGSMLQIAEADSLEESTRHLAIEFVITLAEARERAPGMMRKLPQFISRLFGILMNMLLDIEDDPAWHTADTEDEDAGESDNYGFGQECLDRLSISLGGNSIVPVASEMFPAFLAAPEWQKHHAALIALSQIAEGCSKVMIKNLEQVLSMVLNSFQHPHPRVRWAAINAIGQLSTDLGPDLQAQYHHLVVPALAGAMDDFQNPRVQAHAASAVLNFSENCTPDILTPYLDGIVSKLLVLLQNGKQMVQEGALTALASVADSSQEHFQKYYDAVMPYLKAILVNASDKSNRMLRAKSMECISLVGMAVGKDKFKDDAKQVMDVLLSLQGSPMEADDPTTSYMLQAWARLCKCLGQDFLPYMSVVMPPLLQSAQLKPDVTITSADSDADIDDDDDSIETITLGDKRIGIKTSVLEEKATACNMLCCYADELKEGFFVWIDQVAPTLVPLLKFYFHEEVRRAAVSAMPELLRSAKLAVEKGQSQGRDESYVKQLSDYIVPALVEALHKEPEVEICASMLDALNECVQISGPLLDESQVRCIVDEIKHVITASSSRKHERMERAKAEDFDADERELLDEENEQEEEVFDQVGDCLGTLIKTFKASFLPMFDELSSYLTPMWGKDRTAEERRIAICIFDDVVEHCREAALRYYDTYLPFLLEACNDENPDVRQAAVYGIGVCAEFGGSVFKPLVQEALSRLDVVIRHPNAQHSENIMAYDNAVSALGKICQFHRDSINAPQLVPAWLGCLPIKGDLIEAKLVHDQLCSMVERSDKELLGPNNQYLPKIVSIFAEVLCAGKDLATEQTASRMVNLLRQLQQTLPPSTLASTWSSLQPQQQLALQSILSS

SEQ ID NO: 12862 - protein, 1113 aa, Citrullus lanatus
MAADPTQLHQLSLLLGSDRTHFETLISHLMSSSNDQRSQAESLFNLCKQAHPDALALKLADLLHPSAHPEARTMSAILLRRQLIRDDSYLWPRLTPSTQSTLKSVLLSSLQTEESKSISKKLCDTIAELASGILPDGGWNELMPFIFQCVTSDSSKLQESALLIFAQLAQYIGETLVPHLDTLHSVFSQCLASSKTGDVRIAALGAAINFIQCLSTASDRDRFQNLLPLMMQTLTEALNSGQEATAKDALELLIELAGTEPRFLRRQLVDVVGSMLQIAEADSLEESTRHLAIEFVITLAEARERAPGMMRKLPQFISRLFGILMNMLLDIEDDPAWHTADTEDEDAGESDNYGFGQECLDRLSISLGGNSIVPVASEMFPAFLAAPEWQKHHAALIALSQIAEGCSKVMIKNLEQVLSMVLNSFQHPHPRVRWAAINAIGQLSTDLGPDLQAQYHHLVVPALAGAMDDFQNPRVQAHAASAVLNFSENCTPDILTPYLDGIVSKLLVLLQNGKQMVQEGALTALASVADSSQEHFQKYYDAVMPYLKAILVNASDKSNRMLRAKSMECISLVGMAVGKDKFKDDAKQVMDVLLSLQGSPMEADDPTTSYMLQAWARLCKCLGQDFLPYMSVVMPPLLQSAQLKPDVTITSADSDADIDDDDDSIETITLGDKRIGIKTSVLEEKATACNMLCCYADELKEGFFVWIDQVAPTLVPLLKFYFHEEVRRAAVSAMPELLRSAKLAVEKGQSQGRDESYVKQLSDYIVPALVEALHKEPEVEICASMLDALNECVQISGPLLDESQVRCIVDEIKHVITASSSRKHERMERSKAEDFDADERELLDEENEQEEEVFDQVGDCLGTLIKTFKASFLPMFDELSSYLTPMWGKDRTAEERRIAICIFDDVVEHCREAALRYYDTYLPFLLEACNDENPDVRQAAVYGIGVCAEFGGSVFKPLVQEALSRLDVVIRHPNAQHSENIMAYDNAVSALGKICQFHRDSINAPQLVPAWLGCLPIKGDLIEAKLVHDQLCSMVERSDKELLGPNNQYLPKIVSIFAEVLCAGKDLATEQTASRMVNLLRQLQQTLPPSTLASTWSSLQPQQQLALQSILSS

SEQ ID NO: 12863 - protein, 1116 aa, Chenopodium quinoa
MASELTQFQHASMAAILGPDPSHFETLISQLMSTNNDQRSQSETLYNLCKQHQPDALSLKLAHLLQSSPHPEARAMAAILLRKLLTRDDSFLWPKLSGSTQNTLKSVLLACVPREDAKTISKKLCDTISELAAGIIPDYGWPELLPFMFQCVTSDNPKLRESALLIFAQLAQYIGETLVPHLDTLYNVFFQCLGGNSSAEVRIAALGATINFIQCLTSASDRDRFQDLLPPMMQTLTEALNCGQEATAQEALELLIDLAGTEPRFLRRQLVDVVGAMLQIAEAETLEEGTRHLAIEFVITLAEARERAPGMMRKLPQFIHRLFGILMKMLLDIEDDPVWHTADTEDEDAGESSNYSVAQECLDRLSISLGGNTIVPVASEVLPAHLAAPEWQKHHAALICLAQIAEGCSKVMIKNLEQVVSMVLNSFQDPHPRVRWAAINAIGQLSTDLGPDLQMQYHNRVLPALASSMDDFQNPRVQAHAASAVLNFSENCTPEILTPYLDGIVSKLLVLLQNGKQMVQEGALTALASVADSSQELFQKYYDAVMPYLKAILVNATDKSNRMLRAKSMECISLVGMAVGKEKFRDDAKQVMDVLMQLQGSQMEADDPTTSYMLQAWARLCKCLGQDFLPYMSVVMPPLLHSAQLKPDVTITSADSDADIDESDDESIETITLGDKRIGIKTSVLEEKATACNMLCCYADELKEGFFPWIDQVAPTLVPLLKFYFHEEVRKAAVSAMPELLRSAKLAVEKGLAQGRNESYVKQLSDYIIPALVEALHKEPEVEICSNMLDALNECIQVSGTLLDESQVRIIVDEIKQVITASASRKAERAERIKAEDFDAEEGEILTEENEQEEELFDQIGDCLGTLIKTFKASFLPFFDELSSYLTPMWGKDKTTEERRIAICIFDDVVEHCREAALRYYDTFLPFLLEACNDDNSDVRQAAVYGLGVCAEFGGSVFKPLVREALSRLDAVIRHPNATRAENVMAYDNAVSALGKICQFHRDSIDAAQVVPMWLNCLPIKGDLIEAKVVHDQLCSMVERSDGDLLGPNNQYLSKIVAVFAEVLCAGKDLATEQTASRMVNLLRQLQQTLPPSTLASTWSSLQPQQVLALQSILSQ

SEQ ID NO: 12864 - protein, 1124 aa, Elaeis guineensis
QEQEQQQQVAAIIGAADPAPFEALVSQLMSSVNEQRSQAEALFNLCRDRHPDSLALKLAHLLHSSSRVEIRAMSAILLRKVLTRGSSSSDAAAVSPSYLWPRLSPATQSSLKSLLLSAVQREDSKSIAKKLCDTVSELASSLLPDDAWPELLPFMFQAVTSTDFPRLQESSLFIFSQLAQYIGDALLPHLSTLHGVFLSSLSHHSSPDVRIAALGAAINFIQCLPSATDRDRFQDLLPAMMRTLTEALNSGQEATAQEALELLIELASTEPRFLRRQLPDVVSAMLQIAEADRLEDGTRHLAVEFVITLAEARERAPGMMRRLPQYIGRLFAVLMKMLLDIQDEPAWHSAETEDEDAGETSNYSVGQECLDRLSIALGGNTIVPVVSELLPAYLAAPEWQKHHAALIMLAQIAEGCSKVMIKNLEQVVNVVLNLFQDPHPRVRWAAINAVGQLSTDLGPDLQMQYHHLVLPALASAMDDFQNPRVQAHAASAILNFSENCTPEILTPYLDGIVSKLLVLLQNGKQMVQEGALTALASVADSSQEHFQKYYDAVMPYLKAILMNATDKSTRMLRAKSMECISLVGMAVGKDKFRDDAKQVMEVLMTLQGSQLETDDPITSYMLQAWARLCKCLGQDFLPYMNVVMPPLLQSAQLKPDVTITSADSDDDIDESDDDSIETITLGDKRIGIRTSILEEKATACNMLCCYADELKEGFFPWIDQVAPTLVPLLKFYFHEEVRKAAVSAMPELLRSAKLAVEKGQAQGRDESYVKQLSDYIIPALVEALHKEPETEICASMLDSLNECIQLSGMLLDENQVRCIVDEIKHAITASTTRKRERAERTKAEDFDAEEGELLREENEQEEEVFDQVGDCLGTLIKTFKASFIPFFDELSIYITPMWGKDKTAEERRIAICIFDDVAEQCREAALKYYDTYLPFLLEACNDENAAVRQAAVYGVGVCAEFGGSVFRPLVGEALCRLNNVIRHPNALDSDNVMAYDNAVSALGKICQFHRDNIDAAQVFPAWLSCLPIKNDLIEAKIVHDQLCSMVERSDRELLGPNNQYLPKIISVFAEILCGGKDLATEQTASRMINLLRQLQQTLPPSVLASTWSSLQPQQQLALHSVLSS

SEQ ID NO: 12865 - protein, 1115 aa, Prunus mume
MATDPTQQQQQLAIILGPDPTHFETLISHLMSSSNDQRSQAEALFNLCKQAHPDALLLKLLHVLQSSTRPESRTMAVILLRRQLTHDDSFLWPRLTPNTQSTLKSLLLSSLQSESSKSMSKKLCDTISELASSLLPENQWPELLPFMFQCVTSDNPKLQESALLIFAQLAHYIGETLVPHLTTLHEVFFRCLSTSAKSADVRIAALGASVNFIQCLTSAAERDRFQDLLPLMMQTLTEALNCGQEATAQEALELLIELAGTEPRFLRRQLVDVVGSMLQIAEAESLEEGTRHLAIEFVITLAEARERAPGMMRKLPQFIQRLFAILMNMLLDIEDEPEWHAADTENEDAGETSNYGFGQECLDRLSISLGGNTIVPVASEVFPAFLAAPEWKKHHAAHIALAQIAEGCSKVMIKNLEQVVSMVLNSFQDPHPRVRWAAINAVGQLSTDLGPELQVQYHQRVLPALAGAMDDFQNPRVQAHAASAVLNFSENCTPDILTPYLDGIVSKLLVLLQNGKQMVQEGALTALASVADSSQEQFQKYYDAVMPYLKAILINANDKSNRMLRAKSMECISLVGMAVGKDKFRDDAKQIMEVLMSLQGSQMEADDPTTSYMLQAWARLCKCLGQDFLPYMNVVMPSLLQSAQLKPDVTITSADSDADIDEDDDSIEMITVGDKRIGIRTSVLEEKATACNMLCCYADELKEGFFPWIDQVAPTLVPLLKFYFHEEVRKAAVSAMPELLRSAKLAVEKGLAQGHNESYIKQLSDYIIPALVEALHKEPEVEICASILDALKECVQISGVLLDENQVRCIVDEIKQVVTASSSRKQERAERAKAEDFDAEEGELLKEENEQEEELFDLVGDCLGSLIKTFKASFIPFFDELSTYVTLMLGKDKTAEERRIAICIFDDMAEHCREAALKYYDTYVPFLLEACNDESSDVRQAAVYGVGLCAEYGGSVFKPLVGEALSRLDMVIRHPNAQHSDNVMAYDNAVSAFGKICQFHRDSIDATQLVPAWLSCLPIKGDLIEAKVVHDQLCSMVERSDRELLGPNNQYLPKIVAVFAEVLCAGKDLATEQTASRMVSLLRQLQQTLPPSTLESTWSSLQPQQQLALQFILSS

SEQ ID NO: 12866 - protein, 1116 aa, Eutrema parvulum
MASEANQLQQAQLAMVLGSDSAPFETLISHLMSSSNEQRSSAEALFNLAKQSNPDTLALKLAHLLQLSPHPEGRAMAAVLLRKLLTRDDAYLWPRLSLPTQSSLKSSMLSCIQREEAKSISKKICDTVSELASGILPENGWPELLPFVFQCVSSDSSKLQESAFLILAQLSQYVGETLTPHIKHLHGIFLQCLSSNSASSDVKIAALNAVISFVQCLSNSTERDRFQDVLPAMIRTLTESLNNGNEATAQEALELLIELAGTEPRFLRRQLLDIVSSMLQIAEADSLEESTRHLAIEFLVTLAEARERAPGMVRKLPQFIDRLFAVLMKMLEDIEDDPAWYSAETEDEDAGETSNYSMGQECLDRLAISLGGNTIVPVAYQQFSAYLVASEWQKHHASLIALAQIAEGCSKVMIKNLEQVVSMVLSQFQSPHPRVRWAAINAIGQLSTDLGPDLQNQHHQRVLPALAAAMDDFQNPRVQAHAASAVLNFSENCTPEILAPYLDGVVSKLLVLLQNGKQMVQEGALTALASVADSSQEHFQKYYDVVMPYLKTILMNATDKSKRMLRAKSMECISLVGMAVGKDKFRDDARQVMEVLMSLQGSEMEADDPITSYMLQAWARLCKCLGQDFLPYMNVVMPPLLQSAQLKPDVTITSADSDDEAEDSDDESMETIILGDKRIGIKTSVLEEKATACNMLCCYADELKEGFFPWIDQVAPTLVPLLKFYFHEEVRRAAVSAMPELMRSAKLAIEKGTSQGRDLSYLKQLSDYIIPAMLEALHKEPDTEICVSMLEAINECLQISGNLLDEGKIRSIVDEVKQVMTASASRKRERGERANAEDFDAEEGELIKEENEQEEEIFDQVGEILGTLVKTFKAAFLPFFDELSSYLTPMWGRDKTAEERRIAICIFDDVAEQCRDAAFKYYDTYLPFVLEACNDESPEVRQAAVYGLGVCAEFGGSVFKPLVGEALSRLNVVIQQPNARQSENAMAYDNAVSAVGKICQFHRDSIDSSQVLPAWLNCLPISNDVIEAKVVHDQLCSMVERQDVELLGPNNLYLPKIVTVFAEVLTGKDVVTEETAGRMINILRQLQQTLPPSSLASIWSTLKPEQQQALQSMLSS

SEQ ID NO: 12867 - protein, 1086 aa, Papaver somniferum
MAAGNEQRSQAENLFNICKQDHPDALTLKLAHVLQNSPHLEARAMAAILLRKQLTRDDSYLWPRLSQSTQSALKSQLLMCVQNEEAKQISKKLCDTVSELAAGILPENQWPELLPFMFQCVTSDIPRLQESSLLMFAQLSQHIGDTLIPHIDTLHRVFLQCLASSSNPDVRIAALGASINFVQCLTSLSDRDKFQDLLPVMMKTLTEALNSGQEATAQEALELLIELAGTEPKFLRRQLVDVVGSMLQIAEAESLEEGTRHLAIEFVITLAEARERAPGMMRKLPQFISRLFAILMKMLLDIEDDPVWHKADTEEEEDAGETSNYSVGQECLDRLSIALGGNTIVPVASELLPVFLAAPEWQKHHAALIALAQIAEGCSKVMTKNLEQVVNMVLNSFHDPHPRARWAAINAIGQLSTDLGPDLQLQYHQRVLPALASAMDDFQNPRVQAHAASAVLNFSENCTPDILTPYLDGIVSKLLVLLQNGKQMVQEGALTALASVADSSQEQFQKYYDAVMPYLKAILLNATDKSNRMLRAKSMECISLVGMAVGKDKFRDDAKQVMEVLMTLQGAELDTDDPTISYMLQAWARLCKCLGQDFLPYMSVVMPPLLHSAQLKPDVTITSADSDDDIDQSDDESIETITLGDKRIGIKTSVLEEKATACNMLCCYADELKEGFYPWIDQVAPILVPLLKFYFHEEVRKAAVSAMPELLRSAKLAVEKGQAQGRNETYVKQLSDYIVPALVEALHKEPETEICASMLDALNECVQVSGTLLDESQVRSIVDGIKEVITASSTRRRERAERTQAEDFDAEEGELLKEENEQEEEVFDQVGDLLGTLIKTFKVSFLPFFDELSSYLTPMWGKDKTAEERRVAICIFDDVAEQCHEAALKYYDTYLPFLLEACNDENSDVRQAAVYGVGVCAEFGGAPFKPLVGEALSRLNVVIRHPNALSTDNVMAYDNAVSAVGKICRYHRDSIDSSQVVPAWLSCLPIKGDLIEAKLVHDQLCSMVEGSDRDLLGPNNQYLPKIVSVFVEVLCGGKDLATDQTSSRMIVLLRQLQQTLPPDTLAQAWSSLQPQQQLALQSMLSS

SEQ ID NO: 12868 - protein, 1102 aa, Silene vulgaris
AILGPDPTHFETLISHLMSTNNDQRSTAESLYNLCKQHQPDSLSLQLARMTQSSPHPEARAMSAILLRKLLTRDDSFIYPKLAPATQSSLKSILLACIQSEDTKTISRKLCDTVSELAATIVPEHQWPELLPFMFQCVTSDNPKLREMALLIFAQLSQYIGETLIPHLTTLHNVFLQCLSGNTTADVRIAALSATINFIQCLTTSSDRDRFQDLLPPMMQTLTEALNSGQEATAQEALELLIDLAGTEPRFLRRQLVDVVGAMLQIAEAEALEEGTRHLAIEFVITLAEARERAPGMMRKLPQFIQRLFGILMKLLLDVEDDPVWHSAVTEDEDAGETSNYSVAQECLDRLAISLGGNTIVPVASELLPVFLAAPEWQKHHAALICLAQIAEGCAKVMIKNLEQVVSMVLNSFQDPHPRVRWAAINAIGQLSTDLGPDLQTQYHHLVVPALASAMDDFQNPRVQAHAASAVLNFSENCTPELLTPYLDGIVSKLLVLLQNGKPMVQEGALTALASVADSSQELFQKYYDVVMPYLKAILVNATDKANRMLRAKSMECISLVGMAVGKEKFREDAKQVMEVLMQLQGSQMEADDPTTSYMLQAWARLCKCLGQDFLPYMNVVMPPLLHSAQLKPDVTITSADSDVDIDESDDESIETITVGDKRIGIKTSVLEEKATACNMLCCYADELKEGFFPWIDQVAGILVPLLKFYFHEEVRKAAVSAMPELLRSAKLAIEKGLGQGRNEAYLKQLSDYIIPPLVEALHKEPEVEICSSMLDALKECIQVVGPLLDENQVRSIVNEIKHTITASSSRKADRAERAKAEDFDAEEGELLSEENEQEEELFDQVGDCLGTLIKTFKASFLPFFDELSSYLTPMWGKDKTAEERRIAICIFDDVVEHCRESALRYYDTFLPFLLEACNDENPDVRQAAVYGLGVCAELGGSVFKPLVGESLSRLNVVLSHPNASHSDNVMAYDNAVSALGKVCQFHRDSIDAAQIVPMWLNYLPIKGDLIEAKVVHEQLCSMVERSDGDLLGPNNHYLPKIVAVFAEVLCAGKDLATEQTVSRMINLLRQLQQTLPPATLASTWSSLQPQQQLALQSILSQ

SEQ ID NO: 12869 - protein, 1115 aa, Eutrema halophilum
MASEANQLQQAQLAMVLGSDSAPFETLISHLMSSSNEQRSSAEALFNLAKQSNPDTLALKLAHLLQLSPHPEGRAMAAVLLRKLLTRDDAYLWPRLSLSTQSSLKSSMMSCIQHEEVKSISKKICDTVSELASGILPENGWPELLPFVFQCVSSDSPKLQESAFLVLAQLSQYVGETLTPHIKLLHGVFLQCLSSNSASSDVKIAALNAVISFVQCLTNSTERDRFQDVLPAMIRTLTESLNNGNEATAQEALELLIELAGTEPRFLRRQLLDIVGSMLQIAEADSLEESTRHLAIEFLVTLAEARERAPGMVRKLPQFIDRLFAVLMKMLEDIEDDPAWYSAETEDEDAGETSNYSMGQECLDRLAISLGGNTIVPVAYRQFSAYLAASEWQKHHASLIALAQIAEGCSKVMIKNLEQVVSMVLSQFQSPHARVRWAAINAIGQLSTDLGPDLQNQHHQRVLPALATAMDDFQNPRVQAHAASAVLNFSENCTPEILAPYLDGVVSKLLVLLQNGKQMVQEGALTALASVADSSQEHFQKYYDAVMPYLKTILMNATDKSKRMLRAKSMECISLVGMAVGKDRFRDDARQVMEVLMSLQGSEMEADDPITSYMLQAWARLCKCLGQDFLPYMSVVMPPLLQSAQLKPDVTITSADSDDEAEDSDDESMETIILGDKRIGIKTSVLEEKATACNMLCCYADELKEGFFPWIDQVAPTLVPLLKFYFHEEVRRAAVSAMPELMRSAKLAIEKGISQGRDLSYLKQLSDYIIPAMLEALHKEPDTEICVSMLEAINECLQISGNLLDEGKIRSIVDEVKQVMTASSSRKRERGERANAEDFDAEEGELIKEENEQEEEIFDQVGEILGTLVKTFKASFLPFFDELSSYLTPMWGRDKTAEERRIAICIFDDVAEQCRDAAFKYYDTYLPFVLEACNDESPEVRQAAVYGLGVCAEFGGSVFKPLVGEALSRLNVVIQQPNARQSENAMAYDNAVSAVGKICQFHRDSIDSSQVLPAWLNCLPISNDVIEAKVVHDQLCSMVERQDEDLLGPNNQYLPKILMVFAEVLTGKDVVTEETAGRMINILRHLQQTLPSALASTWSALKPEQQLALQSMLSS

SEQ ID NO: 12870 - protein, 1116 aa, Arabidopsis lyrata
MASEANQLQQAQLAMVLGSDSAPFETLISHLMSSSNEQRSSAEALFNLAKQSNPDTLALKLAHLLQLSPHPEGRAMAAVLLRKLLTRDDAYLWPRLSLSTQSSLKSSMLSCIQREEAKSISKKICDTVSELASGILPENGWPELLPFVFQCVSSDSPKLQESAFLILAQLSQYVGETLTPHIKLLHGVFLQCLSSNSASSDVKIAALNAVISFVQCLSNSTERDRFQDVLPAMIRTLTESLNNGNEATAQEALELLIELAGTEPRFLRRQLLDIVGSMLQIAEADSLEESTRHLAIEFLVTLAEARERAPGMVRKLPQFIDRLFAVLMKMLEDIEDDPAWYSAETEDEDAGETSNYSMGQECLDRLAISLGGNTIVPVAYQQFSAYLAASEWQKHHASLIALAQIAEGCSKVMIKNLDQVVSMVLSQFQSPHPRVRWAAINAIGQLSTDLGPDLQNQHHERVLPALAAAMDDFQNPRVQAHAASAVLNFSENCTPEILAPYLDGVVSKLLVLLQNGKQMVQEGALTALASVADSSQDHFQKYYDAVMPYLKTILMNATDKSKRMLRAKSMECISLVGMAVGKDRFKDDARQVMEVLMSLQGSQMEADDPITSYMLQAWARLCKCLGQDFLPYMSVVMPPLLQSAQLKPDVTITSADSEDEAEDSDDESMETIILGDKRIGIKTSVLEEKATACNMLCCYADELKEGFFPWIDQVAPTLVPLLKFYFHEEVRRAAVSAMPELMRSAKLAIEKGESQGRDLSYLKQLSDYIIPAMLEALHKEPDTEICVSMLEAINECLQISGNLLDEGKIRSIVDEIKQVMTASSSRKLERGERAHAEDFDAEERELIKEENEQEEEIFDQVGEILGTLVKTFKASFLPFFDELSSYLTPMWGRDKTAEERRIAICIFDDVAEQCRDAAFKYYDTYLPFVLEACNDESPEVRQAAVYGLGVCAEFGGSVFKPLVGEALSRLNVVIQQPNARQSENAMAYDNAVSAVGKICQYHRDSIDSSQVLPAWLNCLPISNDVIEAKVVHEQLCSMVERQDVDLLGPNNQYLPKILIVFAEVLTGKDVVTEETAGRMINILRQLQQTLPPSALASTWSTLKPEQQLALQSMLSS

SEQ ID NO: 12871 - protein, 1051 aa, Cucumis sativus
MDPQSTQLQQAQLAAILGPDLAPFETLLSHLMSSSNEQRSQAELVFNLCKQTDPDSLSLKLAHLLQFSPQPEARAMAAVLLRKQLTRDDSYLWPRLNPSSQSSLKSILLSCIQREDSKSISKKLCDTVSELASGILPDNGWPELLPFMFQCVSSDSPKLQESAFLIFAQLSHYIGDTLVPHIKHLHGVFLQCLTSTTSSTDVKIAALNAVISFIQCLSNSADRDRFQDLLPPMMRTLMEALNNGQEATAQEALELLIELAGTEPRFLRRQLVDVVGSMLQIAEAESLDEGTRHLAIEFVITLAEARERAPGMMRKMPQFISRLFAILMKLLLDIEDDPAWHAAENEDEDAGETSNYSVGQECLDRLAISLGGNTIVPVASELFPAYLATPEWQNRHAALIAMAQIAEGCSKVMIKNLEQVVAMVLNSFQDPHPRVRWAAINAIGQLSTDLGPDLQVQYHQQVLPALATAMDDFQNPRVQAHAASAVLNFSENCTPDILTPYLDGIVGKLLLLLQNGKQMVQEGALTALASVADSSQEYFQKYYDAVMPYLKAILVNATDKTKRMLRAKSMECISLVGMAVGKEKFRDDAKQVMEVLMSLQGSQMEADDPTTSYMLQAWARLCKCLGQDFLPYMSVVMPPLLQSAQLKPDVTITSADSDNDIEDSDDDSMETITLGDKRIGIKTSVLEEKATACNMLCCYADELKEGFFPWIDQVAPTLVPLLKFYFHEEVRKAAVSAMPELMRSAKLAVEKGLAQGRNETYIKQLSDYIVPALVEALHKEHDTEICSSMLEALNECLQISGSLLDESQVRSIVDEIKQVITASSSRKRERAERAKAEDFDAEEGELIKEENEQEEEVFDQVGEILGTLIKTFKASFLPFFQELSTYLTPMWGKDKTPEERRIAICIFDDVAEQCREAALKYYDTYLPFLLEACNDENPDVRQAAVYGLGVCAEFGGSVFKPLVGEALSRLNVVLRHPNARQPENVMAYDNAVSALGKICQFHRDSIDSAQVVPAWLNCLPIKGDLVEAKIVHDQLCSLVERQVGCGTFGPK

SEQ ID NO: 12872 - protein, 1116 aa, Arabidopsis thaliana
MASEANQLQQAQLAMVLGSDSAPFETLISHLMSSSNEQRSSAESLFNLAKQSNPDTLSLKLAHLLQLSPHPEGRAMAAVLLRKLLTRDDAYLWPRLSLSTQSSLKSSMLYCIQHEEAKSISKKICDTVSELASGILPENGWPELLPFVFQCVTSVTPKLQESAFLILAQLSQYVGETLTPHIKELHGVFLQCLSSNSASSDVKIAALNAVISFVQCLANSTERDRFQDVLPAMIRTLTESLNNGNEATAQEALELLIELAGTEPRFLRRQLVDIVGSMLQIAEADSLEESTRHLAIEFLVTLAEARERAPGMVRKLPQFIDRLFAVLMKMLEDIEDDPAWYSAETEDEDAGETSNYSMGQECLDRLAISLGGNTIVPVAYQQFSAYLAASEWQKHHASLIALAQIAEGCSKVMIKNLDQVVSMVLSQFQSPHPRVRWAAINAIGQLSTDLGPDLQNQHHERVLPALAAAMDDFQNPRVQAHAASAVLNFSENCTPEILSPYLDGVVSKLLVLLQNGKQMVQEGALTALASVADSSQEHFQKYYDTVMPYLKTILMNATDKSKRMLRAKSMECISLVGMAVGKDRFKEDARQVMEVLMSLQGSQMEADDPITSYMLQAWARLCKCLGQDFLPYMKVVMPPLLQSAQLKPDVTITSADSEDEAEDSDDESMETIILGDKRIGIKTSVLEEKATACNMLCCYADELKEGFFPWIDQVAPTLVPLLKFYFHEEVRRAAVSAMPELMRSAKLAIEKGESQGRDLSYLKQLSDYIIPAMLEALHKEPDTEICVSMLEAINECLQISGNLLDEGKIRSIVDEIKQVMTASSSRKRERGERAHAEDFDAEEGELIKEENEQEEEIFDQVGEILGTLVKTFKASFLPFFDELSSYLTPMWGRDKTAEERRIAICIFDDVAEQCREAAFKYYDTYLPFVLEACNDESPEVRQAAVYGLGVCAEFGGSVFKPLIGEALSRLNVVIQLPNARQSENAMAYDNAVSAVGKICQFHRDSIDSSQVLPAWLNCLPISNDVLEAKVVHDQLCSMVERQDVDLLGPNNQHLPKILIVFAEVLTGKDVVTQETAGRMINILRQLQQTLPPSALASTWSTLKPEQQLALQSMLSS

SEQ ID NO: 12873 - protein, 1117 aa, Silene vulgaris
MASELTQQQHAQMAAILGPDPSQFETLISHLMSTNNDQRSEAELLYNLCKQHQPDSLSLKLAHLLQSSPHPEARAMAAILLRKLLTRDDSFIYPKLAASTQSTLKSILLASIQTEDTKTISRKLCDTISELAATIVPDNQWPELLPFMFQCVTSDNPKLREMSLLIFAQLAQYIGETTLVPHLTTLHNVFLQCLGGATTADVRIAALSATINFIQCLNTASDRDKFQDLLPPMMQTLTEALNSGQEATAQEALELLIDLAGTEPRFLRRQLVDVVGAMLQIAEAESLEEGTRHLAIEFVITLAEARERAPGMMRKLPQFIHRLFGILMKLLLDIEDDPVWHSADTEDEDAGETSNYSVGQECLDRLAISLGGNTIVPVASEVLPVFLAAPEWQKHHAALICLAQIAEGCSKVMIKNLEQVVSMVLNSFQDPHPRVRWAAINAIGQLSTDLGPDLQTQYHHRVLPALASAMDDFQNPRVQAHAASAVLNFSENCTPEILTPYLDGIVSKLLVLLQNGKPMVQEGALTALASVADSSQELFQKYYDVVMPYLKAILVNATDKANRMLRAKSMECISLVGMAVGKEKFRDDAKQVMEVLMQLQGSQMEADDPTTSYMLQAWARLCKCLGQDFLPYMNVVMPPLLHSAQLKPDVVISNTDSDIDIDESDDETIETITVGDKRIGIKTSVLEEKATACNMLCCYADELKEGFFPWIDQVAGILVPLLKFYFHEEVRKAAVSAMPELLRSAKLAIEKGLAQGRNEAYLKQLSDYMIPPLVEALNKEPEVEICSSILDSIKECVQVTGPLLDENQVRGIVNEIKHVITASSLRKAERAERAKAEDFDAEEGELLNEENEQEEELFDQVGDCLGTLIKTFKASFLPFFDELSSYLTPMWGKDKTTEERRIAICIFDDVVEYCREAALRYYTTFLPFLLEACNDENPDVRQAAVYGLGVCAELGGSVFKPLVGESLSRLNSVIRHPNATHSENVMAYDNAVSALGKICQFHRENIDASQIVPMWLNCLPIKGDLIEAKVVHEQLCSMVERSDRDLLGPNNEYLPKIVAIFAEILCAGKDLGTEQTLSRMINLLRQLQQTLPPATLASTWSSLPPQHQLALQSILSQ

SEQ ID NO: 12874 - protein, 646 aa, Brassica napus
MAAVLLRKLLTRDDAYLWPRLSLPTQSSLKSSMLSCIQREEAKSISKKICDTVSELASGILPENGWPELLPFVFQCVSSDSSKLQESAFLIVAQLSQYVGETLTPHIKHLHGVFLQCLTSESASSDVKIAALNAVISFVQCLSNSNERDRFQDVLPAMIRTLTESLNNGNEATAQEALELLIELAGTEPRFLRRQLLDIVGSMLQIAEAESLEESTRHLAVEFLVTLAEARERAPGMVRKLPQFIDRLFAVLMKMLEDVEDDPAWYSAETEDEDAGETSNYSMGQECLDRLAIALGGNTIVPVAYQQFSAYLVASEWQKHHASLIALAQIAEGCSKVMIKNLEQVVSMVLSQFQSPHPRVRWAAINAIGQLSTDLGPDLQNQHHEIVLPALAAAMDDLQNPRVQAHAASAVLNFSENCTPEILAPYLDGIVSKLLVLLQNGKQMVQEGALTALASVADSSQEHFQKYYDVVMPYLKTILMNATDKSKRMLRAKSMECISLVGMAVGKDKFKEDARQVMEVLMSLQGTEMEADDPITSYMLQAWARLCKCLGQDFLPYMDVVMPPLLQSAQLKPDVTITSADSENEAEDSDDESMETIILGDKRIGIKTSVLEEKATACNMLCCYADELKKGFFPGLIRLHLHWFLC

SEQ ID NO: 12875 - protein, 1115 aa, Brassica rapa
MASDQLQQQAQLAMVLGSDTAPFETLISHLMSSSNEQRSSAEALFNLAKQTNPDTLALKLAHLLQLSPHPEARAMAAVLLRKLLTRDDAYLGPRLSLPTQSSLKSSMLSCIQREEAKSISKKICDTVSELASGILPENGWPELLPFVFQCVSSDSSKLQESAFLIVAQLSQYVGETLTPHIKHLHGVFLQCLTSESASSDVKIAALNAVISFVQCLSNSNERDRFQDVLPAMIRTLTESLNNGNEATAQEALELLIELAGTEPRFLRRQLLDIVGSMLQIAEAESLEESTRHLAVEFLVTLAEARERAPGMVRKLPQFIDRLFAVLMKMLEDVEDDPAWYSAETEDEDAGETSNYSMGQECLDRLAIALGGNTIVPVAYQQFSAYLVASEWQKHHASLIALAQIAEGCSKVMIKNLEQVVSMVLSQFQSPHPRVRWAAINAIGQLSTDLGPDLQNQHHDIVLPALAAAMDDLQNPRVQAHAASAVLNFSENCTPEILAPYLDGIVSKLLVLLQNGKQMVQEGALTALASVADSSQEHFQKYYDVVMPYLKTILMNATDKSKRMLRAKSMECISLVGMAVGKDKFKEDARQVMEVLMSLQGTEMEADDPITSYMLQAWARLCKCLGQDFLPYMDVVMPPLLQSAQLKPDVTITSADSENEAEDSDDESMETIILGDKRIGIKTSVLEEKATACNMLCCYADELKEGFFPWIDQVALTLVPLLKFYFHEEVRRAAVSAMPELMRSAKLAIEKGEAQGRDLSYLKQLSDYIIPNMLEALHKEPDTEICVSMLEAINECLQISGNLLDEGKIRSIVDEVKQVMTASSSRKRERGERANAEDFDAEEGELIKEENEQEEEIFDQVGEILGTLVKTFKASFLPFFDELSSYLTPMWGRDKTAEERRIAICIFDDVAEQCRDAAFKYYDTYLPFVLEACNDESPEVRQAAVYGLGVCAEFGGSVFKPLVGEALSRLNVVIQQPNARQSENAMAYDNAVSAVGKICLFHRDSIDSSQVLLAWLNCLPLSNDVIEAKVVHDQLCSMVERQDVDLLGPNNQYLPKIITVFAEVLTGKDVVTQETAGRMVNILRQLQQTLPPSALGSIWSTLKPEQQHALQSMLSS

SEQ ID NO: 12876 - protein, 1116 aa, Phalaenopsis aphrodite
MDQQVAIVLGADPAAFEALISQLMSSANELRSQAEALFNLCRDRHPDTLALKLAQVLHSSQSLEIRAMAAVLLRKQVTSSSGGDSEESPSYIWSRLSPATQSSIKSLLLSAVQREEMKSIAKKLCDTVSELASNLLPDGTWPELLPFMFQAVTSDSPRLQESALLIFSQLAQYIGDILLPHLPTLHSVFLNSLSNSVSPDVRIAALGASINFVQCLESTADRERFQDLLPAMMRTLTEALNSGNEATAQEALELLIELAGTEPRFLRRQLADVVGSMLQIAEADRLEEGTRHLAVEFVITLAEARERAPGMMRRLPQFIGSLFAVLMKMLLDIEDDPAWHGAETEDEDAGETSNYSVAQECLDRLSIALGGNTIVPVASELLPQYLAAPEWQKRHAALITFAQIAEGCSKVMVKNLEQVVSMVLSSFRDPHPRVRWAAINAIGQLSTDLGPDLQVHYHQQVLPALASAMDDFQNPRVQAHAASAVLNFTESCTPDTLSPYLDGIVSKLLVLLQNGKQMVQEGALTALASVADSSQEHFQKYYDAVMPYLKAILMNATDKSNRMLRAKSMECISLVGMAVGKDKFRDDAKQVMEVLMTLQGSQLESDDPITSYILQAWARLCKCLGQDFLPYMNVVMPPLLKSAQLKPDVTITSADTDEEVDDSDDDSIETITLGDKRIGIRTSVLEEKATACNMLGCYADELKEGFFPWIDQVAPTLVPLLKFYFHEEVRKAAVSAMPELLRSAKLAVEKGQASGRDESYVKQLSDYIIPALVEALHKEPEVEICASMLDSLNECAELAGQLLSEGQVRSIVDELKHVITASSTRKRERAERTKAEDFDADEGDLLKEENEQEEEVFNQVGDCLGTLIKTFKASFLPFFDEISIYVTAMLGKDKTPEERRIAICIFDDVAEQCQEAALKYYVTYVPFLLEACNDENSDVRQAAVYGIGVCAEFGGSVFRPLVGEALSRLNNVIRHPNAQHSDNIMAYDNAVSALGKLCQFHRDSIDAAQVVPSWLSCLPIKGDLIEAKLVHEQLCMMVERSDGELLGPNNQYLPKIVSVFAEVLCAGKDLATEQTASRMVNLLRQLQQTLPPAVLASTWSALHPQQQLALQSVLST

SEQ ID NO: 12877 - protein, 1116 aa, Phalaenopsis aphrodite
MDQQVAIVLGADPAAFEALISQLMSSANELRSQAEALFNLCRDRHPDALALKLAQVLHSSQSLEIRAMVAVLLRKQVTSSSGGDSEESPSYIWSRLSPATQSSIKSLLLSAVQREEMKSIAKKLCDTVSELASNLLPDGTWPELLPFMFQAVTSDSPRLQESALLIFSQLAQYIGDILLPHLPTLHSVFLNSLSNSVSPDVRIAALGASINFVQCLESTADRERFQDLLPAMMRTLTEALNSGNEATAQEALELLIELAGTEPRFLRRQLADVVGSMLQIAEADRLEEGTRHLAVEFVITLAEARERAPGMMRRLPQFIGSLFAVLMKMLLDIEDDPAWHGAETEDEDAGETSNYSVAQECLDRLSIALGGNTIVPVASELLPQYLAAPEWQKRHAALITFAQIAEGCSKVMVKNLEQVVSMVLSSFRDPHPRVRWAAINAIGQLSTDLGPDLQVHYHQQVLPALASAMDDFQNPRVQAHAASAVLNFTESCTPDTLSPYLDGIVSKLLVLLQNGKQMVQEGALTALASVADSSQEHFQKYYDAVMPYLKAILMNATDKSNRMLRAKSMECISLVGMAVGKDKFRDDAKQVMEVLMTLQGSQLESDDPITSYILQAWARLCKCLGQDFLPYMNVVMPPLLKSAQLKPDVTITSADTDEEVDDSDDDSIETITLGDKRIGIRTSVLEEKATACNMLGCYADELKEGFFPWIDQVAPTLVPLLKFYFHEEVRKAAVSAMPELLRSAKLAVEKGQASGRDESYVKQLSDYIIPALVEALHKEPEVEICASMLDSLNECAELAGQLLSEGQVRSIVDELKHVITASSTRKRERAERTKAEDFDADEGDLLKEENEQEEEVFNQVGDCLGTLIKTFKASFLPFFDEISIYVTAMLGKDKTPEERRIAICIFDDVAEQCQEAALKYYVTYVPFLLEACNDENSDVRQAAVYGIGVCAEFGGSVFRPLVGEALSRLNNVIRHPNAQHSDNIMAYDNAVSALGKLCQFHRDSIDAAQVVPSWLSCLPIKGDLIEAKLVHEQLCMMVERSDGELLGPNNQYLPKIVSVFAEVLCAGKDLATEQTASRMVNLLRQLQQTLPPAVLASTWSALHPQQQLALQSVLST

SEQ ID NO: 12878 - protein, 1112 aa, Lotus japonicus
MDPNQVALILGPDSSHLESLISNFISTGNEQRSQAETLFNLCKQTHPDSLILRLAQLLHSSPNPETRTMATILLRRHLTRHHDDSFLWPHLSPPTRSTLCSLLLSSLHREPQKSISKKLCDTVSELASALLPDDPAAWPELLPLLFQWVTSPDPRLQEIALLVFAQLAHYIGETLVPQLTTLQSVFLRCLSSSTSSDVRIAALAASVNFVQCLSSPSDRDRLQDLLPLMMQTLTEALNSGQEATAQEALELLIELAGTEPRFLRRQIVDVVGSMLQVAEAPSLEEGTRHLAIEFVVTLAEARERAPGMMRKLPQFIQRLFGVLMNLLLDIEDEPAWHAAETEDEVAGETSNYGFGQECLDRLSISLGGNTIVPVASELLPAYLAAPEWQKHHAALIALAQIAEGCSKVMIKNLEQVLSMILNSFHDPHPRVRWAAINAIGQLSTDLGPDLQVKYHHLVLPALAGAMDDFQNPRVQAHVASAVLNFTENCTPDILTPYLDGIVSKLLVLLQNGKQMVQEGALTALASVADSSQEQFQKYYDAVMPYLKAILMNANDKTNRMLRAKAMECISLVGMAVGKEKFRDDAKQVMDVLMSLQQSQLEADDPTASYMLQAWARLCKCLGQDFLPYMNFVMPPLLQSAQLKPDVTITSADSDAEFDEDDDSIETITLGDKRIGIKTSVLEEKATACNMLCCYADELKEGFFPWIDQVAFTLVPLLKFYFHEEVRKAAVSAMPELLSSAKSAVEKGQSQGRDETYVKQLSDYIIPNLVESLHKEPEVEICANILDALNECIQVSGSHLDEKQVRSIVDEIKQVLTASSSRKHDRADRAKEEDFDAEERELLKEENEQEEELFDQVGDCLGTLIKTFRASFLPFFDELSSYLTPMFGKDKTPEERRIAICIFDDVAEHCRETALKYYDSYLPFLLEACNDECSDVRQAAVYGVGVCAEFGGSVFKPLVGEALSRLNAVIGHPNALHSDNVMAYDNAVSALGKICQFHRDSINATQVVPAWLSCLPLKGDLIEARVVHDQLCSMVERSDRELLGPNNQYLSKIVAVFAEILCAGNSLATEQTVSRMINLLRQLQQTLPPSTLASTWSSLQPQQQLALQSILSS

SEQ ID NO: 12879 - protein, 1111 aa, Brassica rapa
MASEQAQLAMILGSDSAPFETLISHLMSSSNEQRSSAEALFNLAKQTNPDTLALKLAHLLQLSPHPEGRAMAAVLLRKLLTRDDAYLWPRLSLPTQSSLKSTMLACIQREEVKSISKKICDTVSELASGILPENGWPELLPFVFQCVSSDSSKLQESAFLILAQLSQYVGETLTPHIKHLHGVFLQCLSSNSVSSDVKIASLNAVISFVQCLSNSTERDRFQDFLPAMIRTLTESLNNGNEATAQEALELFIELAGTEPRFLRRQLIDVVGSMLQIAEAESLEESTRHLAIEFLVTLAEARERAPGMVRKLPQFIDRLFAVLMKMLEGIEGDPAWYSAETEDEDAGETSNYSMGQECLDRLAIALGGNTIVPVAYQQFSAYLVASEWQKHHASVIALAQIAEGCSKVMIKNLEQVVSMILSQFQSPHPRVRWAAINAIGQLSTDLGPDLQNQHHHIVLPALAAAMDDIQNPRVQAHAASAVLNFSENCTPEILTPYLDGIVSKLLVLLQNGKQMVQEGALTALASVADSSQEHFQKYYDVVMPYLKTILMNATDKSKRMLRAKSMECISLVGMAVGKDKFRDDARQVMEVLMSLQGSEMEADDPITSYMLQAWARLCKCLGQDFIPYMDVVMPPLLQSAQLKPDVTITSADSEDEADDSDDESMETIILGDKRIGIKTSVLEEKATACNMLCCYADELKEGFFPWIAQVAPTLVPLLKFYFHEEVRRAAVSAMPELMRSAKLAIEQGKSQGHDLSYLKQLSDYIIPAMLEALHKEPDTEICVSMLEAINECLQISGNLLDEGKIRSIVDEVKQVMTASSSRKRERGERANAEDFDAEEGELIKEENEQEEEIFDQVGEILGTLVKTFKSSFLPFFDELSSYLTPMWGRDKTAEERRIAICIFDDVAEQCRDAAFKYYDTYLPFVLEACNDESPEVRQAAVYGLGVCAEFGGSVFKPLVGEALSRLNVVIQQPNARQSENAMAYDNAVSAVGKICQFHRDSIDASQVLPAWLNCLPLSNDVIEAKVVHEQLCSMVERQDVDLLGPNNQYLPKILTVFAEVLTRKDVVTEETAGRMINIIRQLQQTLPPSALASVWASLTPEQQVALQSMLST

SEQ ID NO: 12880 - protein, 777 aa, Sciadopitys verticillata
MRQIPRTRMQGSLVIINVGQECLDRLAISLGGNTIVPVASELLPVYLADPDWRKHHAALITLAQIAEGCAKVMIKNLEQVVNMVLKSFQDPHPRVRWAAINAIGQLSTDLGPDLQQQYHQLVLPALAGAMDDFQNPRVQAHAASAVLNFSENCTPDILTPYLDGIVSKLLVLLQNGKQMVQEGALTALASVADSSQEQFQKYYDAVMPYLKAILLNATDKSNRMLRAKAMECISLVGMAVGKDKFRDDAKQVMEVLMTLQGSQMEADDPTISYMLQAWARLCKCLGQDFLPYMNVVMPPLLQSAQLKPDVTITSADSDNDIDDSDDESVETITLGDKKIGIKTSVLEEKATACNMLCCYADELKEGFFPWIDQVAPTLVPLLKFYFHEEVRKAAVSAMPELLQSAKLAVEKGQAQGRDQTYVKQLSDYIIPALVEALHKEPETEICSSMLDALNECIQISGTLLDQGQVKSIVDELKQVITASATRKRERTERTKAEDFDAEEGEILQEENEQEEEVFDQVGECIGTLIKTFKSSFLPFFDELSSYITPMWGKDKTAEERRIAICIFDDVAEQCQEAAVKYYDTYLPFLLEACNDSNADVRQAAVYGIGVCAEFGGSKFKPLVGEALSRLNVVITQPNARDADNVMATDNAVSALGKICQFHRDRIDAAQVIPAWLSCLPIKGDVIEAKIVHEQLCSMVERSDAELLGPNNQYLPKIVSVFAEVLCAGKELATEQTIARMVNLLRQLQQTLSPSALASTWSSLQPQQQLALNSILSS

SEQ ID NO: 12881 - protein, 1114 aa, Glycine max
MASDPMQQVALILGPDSAQLESLISQLMSSSNHHRSQAESLFNLCKQARPEALLLGLAHLLHSSPNPESRTMSAILLRRHLTRHHDSFLWPLLSPPARSSLHSLLLSSLHNEPLKSITKKLCDTVSELAAATLPDDAAAWPDLLPLLFQWVTSPDPRLQEISLLIFAQLAHYIGQTLLPQISTLHSVFLRSLHSSTPSDVRIAALAAAINFIQCLTNSSDRDRFQDLLPLMMQTLTEALNSGQEAVAQEALELLIELAGTEPRFLRRQIADVVGSMLQVAEAEALEEGTRHLAIEFVVTLAEARERAPGMMRKLPQFVRKLFGVLMNLLLDIEDDPAWHGAEDEEEDAGETSNYGFGQECLDRLSISLGGNTIVPVASELLPTYLSAPEWEKHHAALIALAQIAEGCSKVMIKNLEQVLSMILNSFHDPHPRVQWAAINAIGQLSTDLGPDLQVKFHHLVLPALAGAMDDFQNPRVQAHAASAVLNFTENCTSDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEEDDSIETITLGDKRIGIKTSVLEEKATACNMLCCYADELKEGFFPWIDQVAFTLVPLLKFYFHEEVRKAAVSAMPELLSSAKSAVEKGQSQGRDKTYVKQLSDYIIPNLVEALHKEPEVEICASMLDALNECIQVSESHLDEKQVRSIVDEIKQVLTASSSRKHERAERAKEEDFDAEERELLKEENEQEEELFDQVGDCLGTLIKTFRASFLPFFDDLSSYLTPMFGKDKTSEERRIAICIFDDVAEHGREAALKYYDSFLPFLLEACNDEYPDVRQAAVYGVGVCAEFGGSVFKPLVGEALSRLDAVIRHPNALHSDNIMAYDNAVSALGKICQFHRDSINAAQVVPAWLNCLPIKGDLIEAKVVHDQLCSMVERSDRELIGPNNQYLSKIVAVFAEILCAGNNLANEQTVSRMINLLRQLQQTLPPSTLASTWSSLQPQQQLALQSILSS

SEQ ID NO: 12882 - protein, 1118 aa, Glycine max
MASDSIQQSEAQVALILGPDSAHLESLISQLMSSSNDQRSQAESLFNLCKQARPEALLLGLAHLLHSSPNPETRTMSAILLRRHLTRHHDSFLWPLLSPPARSSLHSLLLSSLHNEPLKSITKKLCDTVSELAAATLPDDSAAWPDLLPLLFQWVTSPDPRLQEISLLIFAQLAHYIGQTLLPQISTLHSVFLRSLHSSTPADVRIAALAAAINFIQCLTNSSDRDRFQDLLPLMMQTLTEALNSGQEAVAQEALELLIELAGTEPRFLRRQIVDVVGSMLQVAEAETLEEGTRHLAIEFVVTLAEARERAPGMMRKFPQFVRKLFGVLMNLVLDIEDDPAWHGAVDEDEDAGETSNYGFGQECLDRLSISLGGNTIVPVASELLPTYLAAPEWEKHHAALIALAQIAEGCSKVMIKNLEQVLSMILNSFRDPHPRVRWAAINAIGQLSTDLGPDLQVKFHHLVLPALAGAMDDFQNPRVQAHAASAVLNFTENCTPDILTPYLDGIVSKLLVLLQNGKQMVQEGALTALASVADSSEVQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEDDDSIETITLGDKRIGIKTSVLEEKATACNMLCCYADELKEGFFPWIDQVAFTLVPLLKFYFHEEVRKAAVSAMPELLSSAKSAVVKGQSQGRDETYVKQLSDYIIPNLVEALHKEPEVEICASMLDALNECIQVSGSHLDEKQVRSIVDEIKQVLTASSSRKHERAERAKEEDFDAEERELLNEENEQEEELFDQVGDCLGTLIKTFRTSFLPFFDELSSYLTPLFGKDKTSEERRIAICIFDDVAEHGREAALKYYDSFLPFLLEACNDEYPDVRQAAVYGVGVCAEFGGSVFSPLVGEALSRLDAVIRHPNALHADNIMAYDNAVSALGKICQFHRDSINAAQVVPAWLSCLPIKGDLIEAKVVHDQLCSMVERSDRELIGPNNQYLSKIVAVFAEILCAGNDLATEQTVSRMINLLRQLQQTLPPSTLASTWSSLQPQQQLALQSILSS

SEQ ID NO: 12883 - protein, 653 aa, Podocarpus macrophillus
MQRKHPDALALKLVHVLQSCATVEIRAMAAILLRKQITRDETYIWPRLAPATQTAVKAHLLLCVQREEVKTIVKKLCDTVAELAASILDEGQWPELLPFMFQCVSSDSPRLQESALLMFAQLSQYIGEHLQPHLATLHAVFRQCLSPPSPTDVRIAALGATTNFVQTIESQQERELFQDLLPAMMQTLTEALNRHEEATAQEALEMFIELAGTEPRFLRRQIVDVVGSMLQIAEAESLEEGTRHLAIEFIITLAEARERAPGMMRKLPQFIGRLFAILMKMLLDIEDDPAWHAANTEDEDAGESSNYNVGQECLDRLAISLGGNTIVPVASELLPAYLADPDWKKHHAALITLAQIAEGCAKVMLKTLEQVVNMVLNSFQDPHARVRWAAINAIGQLSTDLGPDLQQQYHQRVLPALAGAMNDFQNPRVQAHAASAVLNFSENCTPDILTPYLDGIVSKLLVLLQNGKQMVQEGALTALASVADSSQEQFQKYYEVVMPYLKAILLNATDKSNRMLRAKAMECISLVGMAVGKEKFRDDAKQVMEVLMTLQGSQMEADDPTISYMLQAWARLCKCLGQDFLPYMSVVMPPLLQSAQLKPDVTITSADSDNDIDDSDDESVETITLGDKKLVSRQVFWRRRLQHATCCVVMLMN

SEQ ID NO: 12884 - protein, 1117 aa, Phaseolus vulgaris
MANDPRQNEAQVALILGPDSTHLESLISQLMCTSNEQRSQAESLFNLCKQARPESLLLALAHLLHTAPNPETRTMSAILLRRHLTRHHDSFLWPLLSPAARSSLHSLLLSSLQQEPVKSIAKKLCDTVSELAAAILPEDPAAWPNLLPLLFQWVTSPEPRLQEVALLIFAQLAHYIGQTLLPQLSTLHSVFLRCLHSSTPSDVRIASLAASINFIQCLTSSADRDRFQDLLPLMMQTLTEALNSGQEAVAQEALELLIELAGTEPRFLRRQIVDVVGAMLQVAEAEALEEGTRHLAIEFVVTLAEARERAPGMMRKLPQFVRKLFGVLLNLLLDIEDAPAWHAAVDEEEDAGETSNYGFGQECLDRLSISLGGNTIVPVASELLPTYLSAPEWEKHHAALIALAQIAEGCSKVMIKNLEQVLSMILNSFCHPHPRVRWAAINAIGQLSTDLGPDLQVKFHHLVLPALAGAMDDFQNPRVQAHAASAVLNFTENCTPDILTPYLEGIVSKLLVLLQNGKQMVQEGALTALASVADSSQEQFQKYYDAVMPYLKAILVNANDKSNRMLRAKAMECISLVGMAVGKEKFRDDAKQVMDVLMSLQQSQLDPDDPTASYMLQAWARLCKCLGQDFLPYMGFVMPPLIQSAQLKPDVTITSADSDTEFDEDDDSIETITLGDKRIGIKTSVLEEKATACNMLCCYADELKEGFFPWIDQVAFTLVPLLKFYFHEEVRKAAVSAMPELLTSAKSAVEKGQSQGRDETYIKQLSDYIIPNLVEALHKEPEVEICSSMLDALNECIQVSGPHLDEKQVRSIVDEIKQVLTASSTRKHERAERAKEEDFDAEERELLKEENEQEEDLFDQVGDCLGTLIKTFRTSFLPFFDELSSYITPMFGKDKTSEERRIAICIFDDVAEHCRETALKYYDSFLPFLLEACNDEYPDVRQAAVYGVGVCAEFGGSVFKPLVGEALSRLDAVIRHPNAQLSDNVMAYDNAVSALGKICQFHRDSINATQVVPAWLSCLPIKGDLIEAKVVHDQLCSMVERSDRELIGPNNQYLPKIVAVFAEILCAGNDLATEQTVSRMINLLRQLQQTLPPSTLASTWSSLQPQQQLALQSILSS

SEQ ID NO: 12885 - protein, 1117 aa, Cajanus cajan
MATDRRQSEAQVALILGPDSSHLESLISHLMSSSNEERSQAESLFNLCKQTHPESLLMGLAHLLHSSPNPETRTMSAILLRRHLTRHHDAFLWPLLSPSARSTLHSLLLSSLHKEPLKSIAKKLCDTVSELAAAILPEDAAAWPDLLPLLFQWVTSPEARLQEISLLVFAQLAHYIGQTLLPQLSTLHSVFLRCLHSSTPSDVRIAALAASINFVQCLSSPSDRDRFQDLLPLMMQTLTEALNSGQEAVAQEALELLIELAGTEPRFLRRQIADVVGAMLQVAEAEALEEGTRHLAIEFVVTLAEARERAPGMMRKLPQFVRKLFGVLMNLLLDIEDDPAWHAAVDEDEDAGETSNYGFGQECLDRLSISLGGNTIVPVASELLPTFLAAPEWQKHHAALIALAQIAEGCSKVMIKNLEQVLSMILNSFHNPHPRVRWAAINAVGQLSTDLGPDLQVKFHHLVLPALAGAMDDFQNPRVQAHAASAVLNFTENCTPDILTPYLDGIVSKLLVLLQNGKQMVQEGALTALASVADSSQVQFQKYYDAVMPYLKAILVNANDKSNRMLRAKAMECISLVGMAVGKDKFREDAKQVMDVLMSLQQSQLDADDPTASYMLQAWARLCKCLGQDFLPYMGFVMPPLLQSAQLKPDVTITSADSDTEFDEDDDSIETITLGDKRIGIKTSVLEEKATACNMLCCYADELKEGFFPWIDQVAFTLVPLLKFYFHEEVRKAAVSAMPELLSSAKSAVEKGQSQGRDETYVKQLSDYIIPNLVEALHKEPEVEICASMLDALNECIQVSGPHLEEKQVRSIVDEIKQVLTASSSRKHERAERAKEEDFDAEERELLKEENELEEELFDQIGDCLGTLIKTFRASFLPFFEELSSYLTPMFGKDKTSEERRIAICIFDDVAEHCREAALKYYDSYLPFLLEACNDEYPDVRQAAVYGVGVCAEFGGSVFKPLVVEALSRLDAVIRHPNAQHSDNIMAYDNAVSALGKICQFHRDSINATQVVPAWLNCLPIKGDVIEAKVVHDQLCSMVERSDRELIGPNNQYLPKIVAVFAEILCAGNDLATEQTVSRMINLLRQLQQTLPPSTLASTWSSLQPQQQLALQSILSS

SEQ ID NO: 12886 - protein, 1116 aa, Cicer arietinum
MANDPNQTQMALILGQDSTHLESLITNLMSSSNDQRSQAENLFNLCKQTYPDSLILKLSQLLHTSPNQETRTMSTILLRRHLTRHHDESFIYPHLSPSTQSTLRSLLLSSLHQEPVKSIAKKLCDTVSELASALLSDDLASWPDLLPLLFQWVTASDTRLQEISLLVFAQLAHYIGETLLPQLSTLHSVFLRCLGASTSADVRIAALAASINFVQCLSNPSDRDRFQDLLPLMMQTLTEALNSGQEATAQEALELLIELAGTEPRFLRRQIVDVVGAMLQIAEADSLEEGTRHLAIEFIVTLAEARERAPGMMRKLPQFVSKLFGVLMNLLLDIEDDPAWHGAETEDEDAGETSNYGFGQECLDRLSIALGGNTIVPVASELLPTYLAAPEWQKHHAALIALAQIAEGSSKVMIKNLEHVLSMVLNSFHDPHPRVRWAAINAIGQLSTDLGPDLQVKYHQLVLPALAGAMDDFQNPRVQAHAASAVLNFTENCAPDTLTPYLDGIVSKLLVLLQTGKQMVQEGALTALASVADSSQEQFQKYYDAVMPYLKAILMNANDKSNRMLRAKAMECISLVGMAVGKEKFKDDAKQVMDVLMSLQQSQLDADDPTASYMLQAWARLCKCLGQDFLPYMGFVMPPLLQSAQLKPDVTITSADSDAEFDEDDDSIETITLGDKRIGIKTSVLEEKATACNMLCCYADELKEGFFPWIDQVAFTLVPLLKFYFHEEVRKAAVSAMPELLSSAKSAIEKGQSQGRDASYLKQLTDYIIPNLVEALHKEPEVEISAGMLDALNECIQVSGPHLDEKQVKSIVDEIKTVITASSSRKQERAERAKEEDFDAEERELLKEENEQEEELFDQIGDCLGTLIKTFRASFVPFFDELSLYLTPMFGKDKTTEERRIAICIFDDVAEHCREAALKYYDSYLPLLLEACNDECSDVRQAAVYGVGVCAEFGGSVFKPLVGEALSRLNAVITHPNARHTDNVMAYDNAVSALGKICQFHRDSINAAQVVPAWLSCLPLKGDLIEAKVVHDLLCSMVERSDRELIGQNNQYLPKIVAIFAEILCAGNDLATEQTVSRMVNLLRQLQQTLPPSTLASTWSSLHPQQQLALQSILSS

SEQ ID NO: 12887 - protein, 1112 aa, Fragaria vesca
MAADPTQQQQQQQLAVLLGQDPAEFETLISHLMSSTNEQRSEAERVFNLCKQAHPDALVLKLVHVLQAAPRPDSRTMSVILLRRQLDSSLWARLSPSTHSSLKSALLSSLHSESTSKSMSKKLCDTVSELASSLLPDNQWPDLLPFMFHCVSSDNPKLQESALFIFAHLAHYIASQAMLPQLTTLHSVFYRCLSSADVRIAALTASVNFIQCLTSPSHRDMFQDLLPLMMQTLTEALNSGQEATAQEALELLIELAGTEPRFLRRQLVDVVGSMLQIAEASSLEEGTRHLAIEFVITLAEARERAPGMMRKLPQFIHRLFAILMTMLLDLDDDPDWHTADTENEDAGETSNYGFGQECLDRLSISVGGNTIIPVASELFPSYLVAPEWQKHHAVHIALAQIAEGCSKVMVQNLEQVVSTVLNSFQDPHPRVRWAAINAVGQLSTDLGPNLQEKYHQRVLPALAGAMDDFQNPRVQAHAASAVLNFSENCTPDILVPYLDGIVSKLLVLLQNGKQMVQEGALTALASVADSSQEQFQKYYDAVMPYLKAILVNANDKANRMLRAKSMECISLVGMAVGKDKFRDDAKQVMEVLMSLQGSEMEADDPTTSYMLQAWARLCKCLGQDFLPYMNVVMPSLLQSAQLKPDVTITSADSDGEIDEDDDSIEMITVGDKRIGIKTSVLEEKATACNMLCCYADELKEGFFPWIDQVAPTLVPLLKFYFHEEVRKAAVSAMPELLRSAKLAVEKGQSQGHNESYIKQLSDYIIPALVEALHKEPEVEICASILDALNECVQSSGPLLDENQVRCIVDEIKQVITAITSRKQERAERAKAEDFDAEEGELLKEENEQEEELFDLVGDCLGTLIKTFKASFLPFFDKLSSYITPMLGKDKTAEERRIAICIFDDIAEHCREAARKYYDTYVPFLLEACNDESSDVRQAAVYGVGLCAEYGGSVFKPLVGEALSRLDMVIRNPSAQHSDNMMAYDNAVSALGKICQFHRDSIDAPQLVPAWLGCLPIKGDLIEAKVVHDQLCSMVERSDRELLGPNNQYLPKIVAVFAEVICAGKDLATEQTTSRMINLLRQLQQTLPPSTLASTWSSLQPQQQLALQFMLSS

SEQ ID NO: 12888 - protein, 1049 aa, Pinus taeda
MRAGGNPGHGRDSPEEADHTGRDIHMATIGTAHADRHQGPPPRLRPEGGGQDHRQEALRHGCRACGFHHGRGPVARAPALHVPVRELRFPASQGERVAHVRAALAVHRRPPPPSSLYPAHRVPPVSLPPSPSDVRIAALAATTNFVQTIETPQDRERFQDLIPAMMQTLTEALNTNQEATAQEALEMFIELAGTEPRFLRRQIVNVVGSMLQIAEAETLEEGTRHLAIEFIITLAEARERAPGMMRKFPQFIGRLFAILMKMLLDIEDDPAWHAANTEDEDAGESSNYSVGQECLDRLAISLGGNTIVPVASELLPAYLADPDWRKHHAALITLAQIAEGCAKVMLKNLEQVVSMVLKSFQDPHPRVRWAAINAIGQLSTDLGPDLQQQYHQQVLPALAGAMDDFQNPRVQAHAASAVLNFSENCTPEILTPYLDGIVSKLLVLLQNGRQMVQEGALTALASVADSSQEHFQKYYDAVMPYLKSILMNATDKSNRMLRAKSMECISLVGMAVGKEKFRNDAKEVMDVLMTLQGSQMEADDPTISYMLQAWARLCKCLGLDFLPYMNVVMPPLLQSAQLKPDVTITSADSDNDIDDSDDESVETITLGDKKIGIKTSVLEEKATACNMLCCYADELKEGFYPWIDQVAPTLVPLLKFYFHEEVRKAAVSAMPELLQSAKLAVEKGMAHGRDQNYVKQLSDYIIPALVEALHKEPETEICSSMLDALNECIQISGVLLDQSQVKSIVDELKQVITASATRKRERTERTTAEDFDAEEGEILQEENEQEEEVFDQVGECIGTLIKTFKSSFLPFFDELSSYITPMLGKDKTAEERRIAICIFDDVAEQCQAAAVKYYDTFLPFLLEACNDSNADVRQAAVYGIGVCAEFGGSKFKTLVGEALSRLNFVISQPNARESDNVMATDNAISALGKICQFHRDSIDAPHVVPAWLSCLPIKGDLIEAKIVHEQLCSMVERSDAELLGPNNLYLPKIVSVFAEVLCAGKDLATDQTIARMVNLLRQLQQTLSPSALASTWSSLQPQQQMALQSILSS

SEQ ID NO: 12889 - protein, 756 aa, Trigonella foenum-graecum
QFNSVLNNGVERSKPNPNGSNSRSRFISLRIPNQKPHVHHQRPTLPSRKSLQSLQTNLPRFPNSQTLPPPPYFPNPETRTMSTILLRRHLTRHHDDSFIYPHLSVSTQSTLRSLLLQSLHQEPIKSIVKKLCDTVSELASALLSDDLSSWPDLLPLLFQWVTSSDPRLQEISLLVFAQLAHYIGETLLPQLSTLHSVFLRCLSAATSSSDVRIAALAASINFVQCLPNSSDRDRFQDLLPLMMQTLTEALNSGQEATAQEALELLIELAGTEPRFLRRQIVDIVGAMLQIAEAESLEEGTRHLAIEFVVTLAEARERAPGMMRKLPQFVKKLFGVLMNLLLDIEDDPAWHAALSEEDDAGETSNYGFGQECLDRLSIALGGNTIVPVASELLPTYLAAPEWQKHHAALVALAQIAEGCSKVMTKNLEHVLSMVLNSFPDPNPRVRWAAINAIGQLSTDLGPDLQDKYHHLVLPALAGAMDDFQNPRVQAHAASAVLNFTENCTPDILIPYLDGIVSKLLVLLQGGKQMVQEGALTALASVADSSQEKFQKYYDAVIPYLKAILLNANDKSNRMLRAKAMECISLVGMAVGKEKFRDDAKQVMDVLMSLQQSQLDSDDPTASYMLQAWARLCKCLGQDFLPYMGFVMPPLLQSAQLKPDVSITSADSDAEFDEDDDSIETITLGDKRIGIKTSVLEEKATACNMLCCYADELKEGFFLGSTRLLPRWFLFLNFTSMKKLGRQQLQLCQNCCLQQNRL

SEQ ID NO: 12890 - protein, 926 aa, Abies balsamea
MDQSKGTVTITAEVEAQINAVLGSESAAFESLITHLMSAGNEQRGQAEVLFNICKEKHPDALALKLVHVLQSCGQVEIRAMAAILLRKQITRDETYIWPRLAPPTQTAIKAHLLVCVQREEAKTIVKKLCDTVAELAASIMEEGQWPELLPFMFQCVSSDSPRLKESALLMFAQLSQFIGEHLHPHLSTLHTVFHQCLSPPSPSDVRIAALAATTNFVQTIETPQDRERFQDLIPAMMQTLNEALNRNEEATAQEALEMFIELAGTEPRFLRRQIINVVGSMLQIAEAESLEEGTRHLAIEFIITLAEARERAPGMMRKFPQFIGRLFAILMKMLLDIEDDPAWHAANTEDEDAGESSNYSVGQECLDRLAISLGGNTIVPVASELLPAYLADPDWRKHHAALITLAQIAEGCAKVMLKNLEQVVSMVLKSFQDPHPRVRWAAINAIGQLSTDLGPDLQQQYHQQVLPALAGAMDDFQNPRVQAHAASAVLNFSENCTPDILTPYLDGIVSKLLGLLQNGRQMVQEGALTALASVADSSQEHFQKYYDTVMPYLKSILMNATDKSNRMLRAKSMECISLVGMAVGKEKFRNDAKEVMEVLMSLQGSQMEADDPTISYMLQAWARLCKCLGQDFLPYMNVVMPPLLQSAQLKPDVTITSADSDNEIDESDDESVETITLGDKKIGIKTSVLEEKATACNMLCCYADELKEGFYPWIDQVAPTLVPLLKFYFHEEVRKAAVSAMPELLQSAKLAVEKGLAHGRDLNYVKQLSDYIIPALVEALHKEPETEICSSMLDALNECIQISGVLLDQNQVKSIVDELKQVITASATRKRERTERTTAEDFDAEEGEILQEENEQEEEVFDQVGECIGTLIKTFKSSFLPFFDELSSYITPMLGKDKTAEERRIAICIFDDVAEQCQAAASKIL

SEQ ID NO: 12891 - protein, 547 aa, Pinus pinaster
MNISLVGMAVGKEKFRNDAKEVMDVLMTLQGSQMEADDPTISYMLQAWARLCKCLGLDFLPYMNVVMPPLLQSAQLKPDVTITSADSDNDIDDSDDESVETITLGDKKIGIKTSVLEEKATACNMLCCYADELKEGFYPWIDQVAPTLVPLLKFYFHEEVRKAAVSAMPELLQSAKLAVEKGMAHGRDQNYVKQLSDYIIPALVEALHKEPETEICSSMLDALNECIQISGVLLDQSQVKSIVDELKQVITASATRKRERTERTTAEDFDAEEGEILQEENEQEEEVFDQVGECIGTLIKTFKSSFLPFFDELSSYITPMLGKDKTAEERRIAICIFDDVAEQCQAAAVKYYDTFLPFLLEACNDSNADVRQAAVYGIGVCAEFGGSKFKTLVGEALSRLNFVISQPNARESDNVMATDNAISALGKICQFHRDSIDAPHVVPAWLSCLPIKGDLIEAKIVHEQLCSMVERSDAELLGPNNLYLPKIVSVFAEVLCAGKDLATDQTIARMVNLLRQLQQTLSPSALASTWSSLQPQQQMALQSILSS

SEQ ID NO: 12892 - protein, 1121 aa, Gossypium raimondii
MATDQTQLQLAQLAHILGPDSTHFETLISHLMSSSNDQRSQAESLFHLAKQTHPDSLSLALSRVLSSSPRPELRALSAVLLRKILTPAADYSFLFPLLAESTRAAIKASLLSSLQTEQSKANVKKLCDTISELASSVVATRGWPELLPFLFQCVNSKNPNLEESALLIFSRLAQNVGETTETLIPHLNTLHSVFFNCLSNPSSCDVRIAALSASVSFIQCISNPKDRDAFQDLLPLMMQTLTEALNSGLEATAQEALELLIELAGTEPRFLRRQIMEVVGSMLQIAEAESLEEGTRHLAIEFIITLAEARERAPGMMRKLPQFIRRLFWVLMNLLVDIEDEPDWYNAESEDEDAGETSNYGVGQECLDRLSISLGGNTVVPVASELFPVFLAASEWQKRHAALIALAQIAEGCSKVMIRNLEQVVSMVLNSFHDAHPRVRWAAINAIGQLSTDLGPELQTQYHQRVLPALAGAMDDFQNPRVQAHAASAVLNFSENCTPDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQVSQMESDDPTTSYMLQAWARLCKCLGQDFLPYMSVVMPPLLQSAQLKPDVTITSADSDANVDDDDDESIETITLGDKRIGIKTSVLEEKATACNMLCCYADELKEGFFPWIDQVATTLVPLLKFYFHEEVRKAAVSAMPELLRSAKLAVEKGQAQGRNGTYIKQLTDYIIPALVEALHKEPEVEICGSMLDSLNECIEICGPFLDEGQIKCIVDEIKQVITASSARKQERAERAKAEDFDEEEGEMLKEENEQEEEVFGQLGDLLGTLIKTFKASFLPFFQELTSYITPMWGKDKTAEERRVAICIFDDIAEHCREAALKYYDTYLPFLLEACNDESPDVRQAAAFGVGLCAEFGGSVFKPLIQEALSRLNAVIRHPNALHLDNVMAYDNAVSALGKICQFHRDSIDAAQILPAWLSCLPIKGDLIEAKIVHEQLCSMVERSDQELLGPNNQYLPKIVSVFAEVLCAGKDLATEQTASRMINLIRHFQQSLPASTLASTWSSLQPQQQLALQSILSS

SEQ ID NO: 12893 - protein, 1118 aa, Medicago truncatula
MALNDQNQAQMALILGPDSTHFESLITNLMSTINDQRSQAENLFNLCKQTYPDSLILKLSHLLHTSSNPETRTMSTILLRRHLTRHHDDSFIYPHLSPSTQSTLRSLLLSSLHQEPIKSIVKKLCDTVSELASALLSDDLSSWPDLLPLLFQWVTSNDARLQEIALLVFAQLAHYIGETLLPQLSTLHSVFLRCLSAATSSSDVRIAALAASINFVQCLSNSSDRDRFQDLLPLMMQTLTEALNSGQEATAQEALELLIELAGTEPRFLRRQIVDIVGAMLQIAEAESLEEGTRHLAIEFVVTLAEARERAPGMMRKLPQFVKKLFGVLMNLLLDIEDDPAWHAAVSEDDDAGETSNYGFGQECLDRLSIALGGNTIVPVASELLPTYLAAPEWQKHHAALVALAQIAEGCSKVMTKNLEHVLSMVLNSFPDPNPRVRWAAINAIGQLSTDLGPDLQDKYHHLVLPALAGAMDDFQNPRVQAHAASAVLNFTENCTPDILVPYLDGIVSKLLVLLQSGKQMVQEGALTALASVADSSQEKFQKYYDAVIPYLKAILLNANDKSNRMLRAKAMECISLVGMAVGKEKFRDDAKQVMDVLMSLQQSQLDSDDPTASYMLQAWARLCKCLGQDFLPYMGFVMPPLLQSAQLKPDVSITSADSDAEFDEDDDSIETITLGDKRIGIKTSVLEEKATACNMLCCYADELKEGFFPWIDQVASTLVPLLKFYFHEEVRKAAASAMPELLSSAKWAIEKGQSQGRDATYLKQLSDYIIPNLVEALHKEPEVEICASMLGALNECIQVSGPHLDEKQVRSIVDEIKQVITASSSRKHERAERAKEEDFDAEERELLKEENELEEELFDQIGDCLGTLTKTFRASFLPFFEELSSYLIPMFGKDKTSEERRIAICIFDDIAEHCREAAHKYYGSFLPFLLEACNDECSDVRQAAVYGVGVCAEFGGSVFKPLVGEALSRLNAVITHPNAQHSDNVMAYDNAVSALGKICQFHRDSINAAQVVPAWLSCLPIKGDLIEAKVVHDLLCSMVERSDKELIGHNNQYLSKIVAIFAEILCAGTDLATEQTVSRMINLLRQLQQTLPPSTLASTWSSLHPQQQLALQSILSS

SEQ ID NO: 12894 - protein, 1128 aa, Gossypium hirsutum
PKTLKLAHGHRSNSAPTRSTRPHLGPDSTHFETLISHLMSSSNDQRSQAESLFHLAKQTHPDSLSLALSRVLSSSPRPELRALSAVLLRKILTPAADYSFLFPLLAESTRAAIKASLLSSLQTEQSKANVKKLCDTISDLASSVVATRGWPELLPFLFQCVNSKNPNLEESALLIFSRLAQNVGETTETLIPHLNTLHSVFFNCLSNPSSCDVRIAALSASVSFIQCISNPKDRDAFQDLLPLMMQTLTEALNSGLEATAQEALELLIELAGTEPRFLRRQIMEVVGSMLQIAEAESLEEGTRHLAIEFIITLAEARERAPGMMRKLPQFIRRLFWVLMNLLVDIEDEPDWYNAESEDEDAGETSNYGVGQECLDRLSISLGGNTVVPVASELFPVFLAASEWQKRHAALIALAQIAEGCSKVMIRNLEQVVSMILNSFHDAHPRVRWAAINAIGQLSTDLGPELQTQYHQRVLPALAGAMDDFQNPRVQAHAASAVLNFSENCTPDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQVSQMESDDPTTSYMLQAWARLCKCLGQDFLPYMSVVMPPLLQSAQLKPDVTITSADSDANVDDDDDESIETITLGDRRIGIKTSVLEEKATACNMLCCYADELKEGFFPWIDQVATTLVPLLKFYFHEEVRKAAVSAMPELLRSAKLAVEKGQAQGRNGTYIKQLTDYIIPALVEALHKEPEVEICGSMLDSLNECIEICGPFLDEGQIKCIVDEIKQVITASSARKQERAERAKAEDFDEEEGEMLKEENEQEEEVFGQLGDLLGTLIKTFKASFLPFFQELTSYITPMWGKDKTAEERRVAICIFDDIAEHCREAALKYYDTYLPFLLEACNDESPDVRQAAAFGVGLCAEFGGSVFKPLIQEALSRLNAVIRHPNALHLDNVMAYDNAVSALGKICQFHRDSIDAAQILPAWLSCLPIKGDLIEAKIVHEQLCSMVERSDQELLGPNNQYLPKIVSVFAEVLCAGKDLATEQTASRMINLIRHFQQSLPASTLASTWSSLQPQQQLALQSILSS

SEQ ID NO: 12895 - protein, 1121 aa, Pseudotsuga menziesii
MDQSKGTIAITAEVEAQINAVLGSESAAFEALITHLMSAGNEQRGQAEALFNICKEKHPDALALKLVHVLQSCGQVEIRAMAAILLRKQITRDETYIWPRLSPPTQTAIKAHLLVCVQREEAKTIVKKLCDTVAELAASIMEEGQWPELLPFMFQCVSSDSPRLKESALLMFAQLSQFIGEHLHPHLSTLHTVFHQCLSPASPSDVRIAALAATTNFVQTIETPQDRERFQDLIPAMMQTLTEALNRNEEATAQEALEMFIELAGTEPRFLRRQIVNVVGSMLQIAEAESLEEGTRHLAIEFIITLAEARERAPGMMRKFPQFIGRLFAILMKMLLDIEDDPAWHAANTEDEDAGESSNYSVGQECLDRLAISLGGNTIVPVASELLPAFLADPDWRKHHAALITLAQIAEGCAKVMLKNLEQVVSMVLKSFQDPHPRVRWAAINAIGQLSTDLGPDLQQQYHQQVLPALAGAMDDYQNPRVQAHAASAVLNFSENCTPDILTPYLDGIVSKLLVLLQNGRQMVQEGSLTALASVADSSQEHFQKYYDAVMPYLKSILMNATDKSNRMLRAKSMECISLVGMAVGKEKFRNDAKEVMEVLMSLQGSQMEADDPTISYMLQAWARLCKCLGQDFLPYMNVVMPPLLQSAQLKPDVTITSADSDNDIDDSDDESVETITLGDKKIGIKTSVLEEKATACNMLCCYADELKEGFYPWIDQVAPTLVPLLKFYFHEEVRKAAVSAMPELLQSAKLAVEKGLAHGRDQNYVKQLSDYIIPALVEALHKEPETEICSSMLDALNECIQISGVLLDQNQVKSIVDELKQVITASATRKRERTERTTAEDFDAEEGEILQEENEQEEEVFDQVGECIGTLIKTFKSSFLPFFDELSSYITPMLGKDKTTEERRIAICIFDDVAEQCQAAAVKYYDTFLPFLLEACNDSNADVRQAAVYGIGVCAEFGGSKFKTLVGEALSRLNFVISQPNARDSDNVMATDNAISALGKICQFHRDSIDAPHVVPAWLSCLPIKGDLIEAKIVHEQLCSMVERSDMELLGPNNQYLPKIVSVFAEVLCAGKDLATEQTIARMVNLLRQLQQTLSPSALASTWSSLQPQQQLALQSILSS

SEQ ID NO: 12896 - protein, 1119 aa, Gossypium raimondii
MATDQTQLQLAQLAHILGPDSTHFETLISHLMSSSNDQRSQAESLFHLAKQTHPDSLSLALSRVLSSSPRPELRALSAVLLRKILTPAADYSFLFPLLAESTRAAIKASLLSSLQTEQSKANVKKLCDTISDLASSVVATRGWPELLPFLFQCVNSKNPNLEESALLIFSRLAQNVGETTETLIPHLNTLHSVFFNCLSNPSSCDVRIAALSASVSFIQCISNPKDRDAFQDLLPLMMQTLTEALNSGLEATAQEALELLIELAGTEPRFLRRQIMEVVGSMLQIAEAESLEEGTRHLAIEFIITLAEARERAPGMMRKLPQFIRRLFWVLMNLLVDIEDEPDWYNAESEDEDAGETSNYGVGQECLDRLSISLGGNTVVPVASELFPVFLAASEWQKRHAALIALAQIAEGCSKVMIRNLEQVVSMVLNSFHDAHPRVRWAAINAIGQLSTDLGPELQTQYHQRVLPALAGAMDDFQNPRVQAHAASAVLNFSENCTPDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQVSQMESDDPTTSYMLQAWARLCKCLGQDFLPYMSVVMPPLLQSAQLKPDVTITDSDANVDDDDDESIETITLGDKRIGIKTSVLEEKATACNMLCCYADELKEGFFPWIDQVATTLVPLLKFYFHEEVRKAAVSAMPELLRSAKLAVEKGQAQGRNGTYIKQLTDYIIPALVEALHKEPEVEICGSMLDSLNECIEICGPFLDEGQIRCIVDEIKQVITASSARKQERAERAKAEDFDEEEGEMLKEENEQEEEVFGQLGDLLGTLIKTFKASFLPFFQELTSYITPMWGKDKTAEERRVAICIFDDIAEHCREAALKYYDTYLPFLLEACNDESPDVRQAAAFGVGLCAEFGGSVFKPLIQEALSRLNAVIRHPNALHLDNVMAYDNAVSALGKICQFHRDSIDAAQILPAWLSCLPIKGDLIEAKIVHEQLCSMVERSDQELLGPNNQYLPKIVSVFAEVLCAGKDLATEQTASRMINLIRHFQQSLPASTLASTWSSLQPQQQLALQSILSS

SEQ ID NO: 12897 - protein, 125 aa, Vigna unguiculata
MACLRFLHAALPQAQLTLGFPSPPQFLTIAPPLKFSLSSSTFRCKTFTRLKVNQRVLTVFAANPNSVDGKSTKEGSDVNESSNAGQGPPILTILAGFFVLFVVCWSIWSIIAWLISLIVTAPAPK

SEQ ID NO: 12898 - protein, 412 aa, Cajanus cajan
MDAIRKQLDVLMGANRNGDVREVNRKYYDRDVCRLYLVGLCPHELFQLTKMDMGPCPKVHSLQLRKEYEEAKAKGTDNYDRELEDVIDKLIGECDRKIGRALKRLEDEDAKAAIAISVSEVTQTPEVLELSKQIKEKLKEADQYDLEGKTDLKIRALEVVEELRTKRADKQSMLLLDAFNKDRASLPTPLPNPPPLAPIPVVAPDPRTQEMINEKLKKAEDLGEQGMVDEAQKALEEAEALKKLPSRQEPVLDSSKYTAADVRITDQKLRVCDICGAFLSVYDSDRRLADHFGGKLHLGYMQIREKLAELQEERNKSRKTDRHDDRRSKERSRDRDRESSKDRERGDSRERGRDYDRRSRDRDRHYDRDRGYDRDRDSDRSRTYDSRSRRRSRSRSRERSRDYDRHRRYDRY

SEQ ID NO: 12899 - protein, 414 aa, Glycine max
MDAIRKQLDVLMGANRNGDVREVNRKYYDRDVCRLYLVGLCPHELFQLTKMDMGPCPKVHSLQLRKEYEEAKAKGTDNYDRELEDVIDKLIGECDRKIGRALKRLEDDDAKAAIAISVSEVTQTDEVLELSKQIKEKLKEADQYDLEGKSDLKIRALEVVEELRTKRADKQSMLLLDAFNKDRASLPTPLPNPPPLAPLPVVAPDARTQEMINEKLKKAEDLGEQGMVDEAQKALEEAEALKKLPARQEPVLDSSKYTAADVRITDQKLRVCDICGAFLSVYDSDRRLADHFGGKLHLGYMQIREKLAELQEERNKSRKTDRLDDRRSKERSRDRDRESSRDHERGDSRERGRDHDRRSRDRDRHYDRDRGYDRDRDRDSDRTRSYDSRSRRRSRSRSQERSRDYDRHRRHDRY

SEQ ID NO: 12900 - protein, 414 aa, Glycine max
MDAIRKQLDVLMGANRNGDVREVNRKYYDRDVCRLYLVGLCPHELFQLTKMDMGPCPKVHSLQLRKEYEEAKAKGTDNYDRELEDVIDKLIGECDRKIGRALKRLEDDDAKAAIAISVSEVTQTDEVLELSKQIKEKLKEADQYDLEGKSDLKIRALEVVEELRTKRADKQSMLLLDAFNKDRASLPTPLPNPPPLAPLPVVAPDARTQEMINEKLKKAEDLGEQGMVDEAQKALEEAEALKKLPARQEPVLDSSKYTAVDVRITDQKLRVCDICGAFLSVYDSDRRLADHFGGKLHLGYMQIREKLAELQEERNKSRKTDRLDDRRSKERSRDRDRESSRDRELGDSRERGRDHDRRSRDHDRHYDRDRGYDRDRDRDSDRTRSYDSRSRRRSRSRSRERSRDYDRHRRHDRY

SEQ ID NO: 12901 - protein, 407 aa, Arachis hypogaea
MDAIRKQLDVLMGANRNGDVREVNRKYYDRDVCRLYLVGLCPHELFQLTKMDMGPCPKVHSLQLRKEYEEAKAKGTDNYDRELEDVIDKLIGECDRKIGRALKRLEDEDAKAAIAISVSEVTQTPEVLELSKEIKEKLKEADQYDLEGKTDLKIRALEVVEELRTKRADKQSMLLLDAFNKDRASLPQPLPNPPPLAPIPVAAPDPRTQEMINEKLKKAEDLGEQGKVDEAQKALEEAEALKKLPARQEPVVDNSNSSKYTAADVRITDQKLRVCDICGAFLSVYDSDRRLADHFGGKLHLGYMQIREKLAELQEERTKSRKSLDDRRSKERSRDREPSRDRDRGDSRERGRDYDRRSRDRDRHHDRDRGYDRERDRDYDRSRRRRSRSRSRERSRDYDRHRRYDRY

SEQ ID NO: 12902 - protein, 414 aa, Prunus mume
MDALRKQLDQLMGANRNGDVREVNRKYYDREVCRLYLVGLCPHELFQLTKMDMGPCPKVHSLQLRKEYEEAKAKGTDNYDRDLEDVIDRLIVECDRKIARALKRLEDDDAKAAIAISVSEVTQTPEVLELSKQIKEKLKEVDQFDLEGKTDLKIRAMEIVDELRGKRADKQSMLLLDAFNKDRASLPQPLPNPPPLAPLPVVVPDARTQEMINEKLKKAEDLGEQGMVDEAQKALEEAEALKKLPARQEPILDSSKYTAADVRITDQKLRVCDICGAFLSVYDSDRRLADHFGGKLHLGYMQIREKLAELQEERNKIRKVDRAEDRRSKERSKERDRESSRDRERGDSRDRGRDHDRRSRDRDRYYDRDRGYDRERDRDSDRSRNYDSRSRRRSRSRSRERSRDYDRHRRYDRY

SEQ ID NO: 12903 - protein, 414 aa, Unknown
  Sequence found in Organisms: Castanea mollissima, Quercus alba
MDAIRKQLDVLMGANRNGDVREVNRKYYDRDVCRLYLVGLCPHELFQLTKMDMGPCPKVHSLQLRKEYEEAKAKAIDNYERDLEDVIDRLILECDRKITRALRRLEAEDAKAAIAISVSEVTQTPEVLELSKQIKEKLKEADQYDLEGKTDLKIRALEVVEELRTKRADKQSMLLLDAFNKDRASLPQPLPNPPPLAPLPVITPDPRTQEMINEKLKKAEDLGEQGLVEEAQKALEEAEALKKLPARQEPALDSSKYTAADVRITDQKLRVCDICGAFLSVYDSDRRLADHFGGKLHLGYMQIREKLAELQEEKEKSRKVDRHDDRRSKERSRDRDREPSRDQERGDSRDQGRDYDRRSRDRDRYHDRERGYDRDRDRDSDRSRSYDSRSRRRSRSRSRERSRDYDRHRRYDRY

SEQ ID NO: 12904 - protein, 414 aa, Prunus persica
MDALRKQLDQLMGANRNGDVREVNRKYYDREVCRLYLVGLCPHELFQLTKMDMGPCPKVHSLQLRKEYEEAKAKGTDDYDRDLEDVIDRLIVECDRKIARALKRLEDDDAKAAIAISVSEVTQTPEVLELSKQIKEKLKEVDQFDLEGKTDLKIRAMEIVDELRGKRADKQSMLLLDAFNKDRASLPQPLPNPPPLAPLPVVVPDARTQEMINEKLKKAEDLGEQGMVDEAQKALEEAEALKKLPARQEPILDSSKYTAADVRITDQKLRVCDICGAFLSVYDSDRRLADHFGGKLHLGYMQIREKLAELQEERNKIRKVDRSEDRRSKERSKERDRESSRDRERGDSRDRGRDHDRRSRDRDRYYDRDRGYDRERDRDSDRSRNYDSRSRRRSRSRSRERSRDYDRHRRYDRY

SEQ ID NO: 12905 - protein, 413 aa, Theobroma cacao
MDAMRKQLDVLMGANRNGDVREVNRKYYDRDVCRLFLSGLCPHELFQLTKMDMGPCPKVHSLQLRKEYEEAKAKGVDNYDRELEDAIDRLIVECDRKIGRALKRLEDEDAKAAIAISVSDVTQTPEVLELSKQIKEKLKEADQHDLEGKTDLKIRALEEVEEFRTKRADKQSMLLLDAFNKDRASLPQPLPNPPALAPLPVPAPDPRTQEMINEKLKKAEDLGEKGMVDEAQKALEEAEALKKLPARQEPVLDSSKYTAADVRITDQKLRVCDICGAFLSVYDSDRRLADHFGGKLHLGYMQIRDKLAELQEERNKSRKLDRHDDRRSKEQSKDCDRESSRDHDRGDSRDRGRDYDRRSRDRDRYYDRDRGHDRDRERDYERSRSYDSRSRRRSRSRSKERSRDYDRHRRDRY

SEQ ID NO: 12906 - protein, 412 aa, Cicer arietinum
MDAIRKQLDVLMGANRNGDVREVNRKYYDRDVCRLYLVGLCPHELFQLTKMDMGPCPKVHSLQLRKEYEEAKSKGIDNYERELEDVIDKLIGECDRKIGRALKRLEDDDAKAAIAISVSEVTQTPEVLELSKEIKEKLKEADKYDLEGLSDMKIRALEIVEELRTRRADKQSTLLLDAFNKDRASLPQPLPNPPPLAPLPVVTPDARTQEMINEKLKKAEDLGEQGLIDEAQKALEEAEALKKLPSRQEPTLDSSKYTAADVRITDQKLRVCDICGAFLSVYDSDRRLADHFGGKLHLGYMQIREKLAELQEERANSRKTDRLDDRRSKERSKDREREPSRDRERGESHERGRDYDRRSRDRDRHHDRDRGYDRDRDRDSDRSRHYDSRSRRRSRSRERSRDYDRHRRHDRY

SEQ ID NO: 12907 - protein, 414 aa, Eucalyptus grandis
MDAIRKQLDVLMGANRNGDVREVNRKYYDRDVCRMYLVGLCPHELFQLTKMDMGPCPKVHSLQLRKEYEEAKGKGVDNYDRDLEDVIDRLIVECDRKIARALKRLEEDDAKAAIAISVSEVTQTPEILELSKQIKEKLKEADQHDLEGKTDLKIRALEIVEELRTKRADKQSMLLLDAFNKDRASLPQPLPNPPPLAPLPVVAPDPRTQEMINEKLKKAEDLGEQGMVDEAQKALEEAEALKKLHARQEPAQDSTKYTAADVRITDQKLRVCDICGAFLSVYDSDRRLADHFGGKLHLGYMQIRDKLAELQEERNKIRKVDHHEDRRSKERSKDRDRESSKDQERADSRDRGRDYDRRSRDRDRHHERDRGYERERDRDIDRPRSYDSRSRRRSRSRSQERSRDYDRHRRRDRY

SEQ ID NO: 12908 - protein, 419 aa, Vitis vinifera
MDAIRKQLDVLMGANRNGDVREVNRKYYDRDVCRLFLVGLCPHELFQLTKMDMGPCPKVHSLQLRKEYEEAKAKGVHNYDRDLEDVIDRLIVECDRKIARALKRLEDEDAKAAIAISVSEVTQTPEVLELSKQIKEKLKEADQFDLEGKTDSKIRALEVVEELRTKRADKQSMLLLDAFNKDRASLPQPLPNPPPLAPLPVLAPDPRTQEMINEKLKKAEDLGEQGMIDEAQKALEEAEALKKLAPRQEPVLDSSKYTAADVRITDQKLRVCDICGAFLSVYDSDRRLADHFGGKLHLGYMQIREKLAELQEERNKSRKVDRHENDRRSKERSRDHDREASKDRADSRERGRDHDRRSRDRDRYHDRDRGHDRERDRDSDRPRNYDSRSRRRSRSRSGERSRDYDRSRDYDRHRRYDRY

SEQ ID NO: 12909 - protein, 419 aa, Vitis vinifera
MDAIRKQLDVLMGANRNGDVREVNRKYYDRDVCRLFLVGLCPHELFQLTKMDMGPCPKVHSLQLRKEYEEAKAKGVHNYDRDLEDVIDRLIVECDRKIARALKRLEDEDAKAAIAISVSEVTQTPEVLELSKQIKEKLKEADQFDLEGKTDSKIRALEVVEELRTKRADKQSMLLLDAFNKDRASLPQPLPNPPPLAPLPVLAPDPRTQEMINEKLKKAEDLGEQGMIDEAQKALEEAEALKKLAPRQEPVLDSSKYTAADVRITDQKLRVCDICGAFLSVYDSDRRLADHFGGKLHLGYMQIREKLAELQEERNKSRKVDRHENDRRSKERSRDRDREASKDRADSRERGRDHDRRSRDRDRYHDRDRGHDRERDRDSDRPRNYDSRSRRRSRSRSGERSRDYDRSRDYDRHRRYDRY

SEQ ID NO: 12910 - protein, 416 aa, Fagus grandifolia
MDAIRKQLDVLMGANRNGDVREVNRKYYDRDVCRLYLVGLCPHELFQLTKMDMGPCPKVHSLQLRKEYEEAKAKAVDNYDRDLEDVIDRLILECDRKITRALRRLEADDAKAAIAISVSEVTQTPEVLELSKQIKEKLKEADQYDLEGKTDLKIRALEVVEELRTKRADKQSMLLLDAFNKDRASLPQPLPNPPPLAPLPVITPDPRTQEMINEKLKKAEDLGEQGLVEEAQKALEEAEALKKLPARQEPALDSSKYTAADVRITDQKLRVCDICGAFLSVYDSDRRLADHFGGKLHLGYMQIREKLAELQEDKEKSRKVDRYDDRRSKERSRDGDREPSKDPERGDSRDQVRDYDRRSRDRDRYHDRERGYDRDRDRDSDRTRSYDSRSRRRSRSRSKERERSRDHDRHRRYDRY

SEQ ID NO: 12911 - protein, 421 aa, Citrus clementina
MDAMRKQLDVLMGANRNGDVREVNRKYYDRDVCRLYLAGLCPHELFQLTKMDMGPCPKVHSLQLRKEYEEAKAKGVDNYDRELEDAIDRLIVECDRKIGRALKRLEDDDAKAAIAISVSEVTQTPEVLELSKQIKEKLKEADQYDYEGKTDLKIRALEVVEELRTKRADKQSMLLLDAFNKDRASLPQPLPNPPPLAPLPIPAPDARTQEMINEKLKKAEDLGEQGMVDEAQKALEEAEALKKLPARQEPTLDSSKYTAADVRITDQKLRVCDICGAFLSVYDSDRRLADHFGGKLHLGYMQIRDKLAELQEERNKKHKDRCDDRRSKERSKDQDREPSRDREKEASRDRDRGDSRDRGRDYDRSSRDRDRYYDRDRRYDRERDRDSDRHRSYDSRSHRRSRSRSKERSRDYDRHRRHDRY

SEQ ID NO: 12912 - protein, 410 aa, Medicago truncatula
MDAIRKQLDVLMGANRNGDVREVNRKYYDRDVCRLYLVGLCPHELFQLTKMDMGPCPKVHSLQLRKEYEEAKSKGTDSYERELEDVIDKLIGECDRKIGRALKRLEDDDAKAAIAISVSEVTQTPEIIELSKEIREKLKEADKFDLEGLSDMKIRALEIVEELRIKRADKQSTLLLDAFNKDRASLPQPLPNPPPLAPLPVVTPDARTQEMINEKLKKAEDLGEQGLIDEAQKALEEAEALKKLPSRQEPPLDSSKYTAADVRITDQKLRVCDICGAFLSVYDSDRRLADHFGGKLHLGYMQIREKLAELQEERNKSRKIDRLDDRRSKERSRDRDREPSRDRERGESHERGRDNDRRSRDRDNRHHDRDRGYDRDRDRDSSRYDSRSRRRSRSRERSRDYDRHRRHDRY

SEQ ID NO: 12913 - protein, 409 aa, Trigonella foenum-graecum
MDAIRKQLDVLMGANRNGDVREVNRKYYDRDVCRLYLVGLCPHELFQLTKMDMGPCPKVHSLQLRKEYEEAKGKGIDNYERELEDVIDKLIGECDRKIGRALKRLEDDDAKAAIAISVSEVTQTPEVLELAKEIKEKLKEADKFDLEGLSDMKIRALEIVEELRIKRADKQSTLLLDAFNKDRAALPQPLPNPPPLAPLPIVTPDARTQELINEKLKKAEDLGEQGLIDEAQKALEEAEALKKLPSRQEPALDSSKYTAADVRITDQKLRVCDICGAFLSVYDSDRRLADHFGGKLHLGYMQIREKLAELQEERNKSRKIERLDDRRSKERSRDHDREPSRDRERGESHERGRDNDRRSRDRDRHHDRDRGYDRDRDRDSSRYDSRSRRRSRSRERSRDYDRHRRHDRY

SEQ ID NO: 12914 - protein, 413 aa, Gossypium hirsutum
MDAMRKQLDVLMGANRNGDVREVNRKYYDRDVCRLFLSGLCPHELFQLTKMDMGPCPKVHSLQLRKEYEEAKSKGVDNYDRELEDAIDRLIVECDRKIGRALRRLEDEDAKAAIAISVSEVTQTPEILELSKQIKEKLKEADQHDLEGKTDLKIRALEEVEELRTTRADKQSILLLDAFNKDRASLPQPLPNPPPLAPLPVAAPDPHIQEMINEKLKKAEDLGEKGMVDEAQKALEEAEALKKLPARQEPVLDSSKYTAADVRITDQKLRVCDICGAFLSVYDSDRRLADHFGGKLHLGYMQIRDKLAELQEERNKSRKLDRYDDRRSKERSRDREREPSRDRDRGESRDRGRDHDRRSRDQDRYHERDRGYDRDRERDYERSRSYDSRSRRRSRSRSREHSRDYDRHRRDRY

SEQ ID NO: 12915 - protein, 421 aa, Citrus sinensis
MDAMRKQLDVLMGANRNGDVREVNRKYYDRDVCRLYLAGLCPHELFQLTKMDMGPCPKVHSLQLRKEYEEAKAKGVDNYDRELEDAIDRLIVECDRKIGRALKRLEDDDAKAAIAISVSEVTQTPEVLELSKQIKEKLKETDQYDYEGKTDLKIRALEVVEELRTKRADKQSMLLLDAFNKDRASLPQPLPNPPPLAPLPIPAPDARTQEMINEKLKKAEDLGEQGMVDEAQKALEEAEALKKLPARQEPTLDSSKYTAADVRITDQKLRVCDICGAFLSVYDSDRRLADHFGGKLHLGYMQIRDKLAELQEERNKKHKDRCDDRRSKERSKDQDREPSRDREKEASRDRDRGDSRDRGRDYDRSSRDRDRYYDRDRRYDRERDRDSDRHRSYDSRSHRRSRSRSKERSRDYDRHRRHDRY

SEQ ID NO: 12916 - protein, 413 aa, Gossypium raimondii
MDAMRKQLDVLMGANRNGDVREVNRKYYDRDVCRLFLSGLCPHELFQLTKMDMGPCPKVHSLQLRKEYEEAKSKGVDNYDRELEDAIDRLIVECDRKIGRALRRLEDEDAKAAIAISVSEVTQTPEILELSKQIKEKLKEADQHDLEGKTDLKIRALEEVEELRTTRADKQSILLLDAFNKDRASLPQPLPNPPPLAPLPVAAPDPHIQEMINEKLKKAEDLGEKGMVDEAQKALEEAEALKKLPARQEPVLDSSKYTAADVRITDQKLRVCDICGAFLSVYDSDRRLADHFGGKLHLGYMQIRDKLAELQEERNKSRKLDRYDDRRSKERSRDREREPSRDRDRGESCDRGRDHDRRSRDQDRYHERDRGYDRDRERDYERSRSYDSRSRRRSRSRSREHSRDYDRHRRDRY

SEQ ID NO: 12917 - protein, 414 aa, Lupinus angustifolius
MDAIRKQLDVLMGANRNGDVREVNRKYYDRDVCRLYLVGLCPHELFQLTKMDMGACPKVHSLQLRKEYVEAKAKGVDNYDRELEDVIDRLIAECERKIGRALKRLEDDDAKAAIAISVTEVTQTPEVLELSKEIKEKLKEADQYDLEGNTDLKIRAMEIVEELRTKRADNQATLLLDAFNKDRASLPQPLPNPPPLAPFPVVPRDPRTQEMINEKFKKAEELGEQGMVDEAQKALEEAEALKKLPPRQEPPLDPSKYTAADVRITDQKLRVCDICGAFLSVYDSDRRLADHFGGKLHLGYMQIREKLAELQEERNKSRKIDWQDDKKSKELSRDRDRESSKDREGGETRERGRDYDHRSRDRDRHNGRDRGYDRDRDRDSDRSRHYDSRSRRRSRSRSRERSRDYDRHRRHDRY

SEQ ID NO: 12918 - protein, 413 aa, Cannabis sativa
MDALRKQLDQLMGANRNGDVREVSRKYYDRDVCRLYLVGLCPHELFQLTKMDMGPCPKVHSLQLRKEYEEAKAKGTDNYDRDLEDVIDRLIVECDRKIARALKRLEDDDAKAAIAISVSDVTQTPEIIELSKQIKEKLKEADQYDLEGKTDLKIRALEVIEELRTQRADKQSMLLLDAFNKDRASLPQPLPNPPPLAPLPVAALDPRTQEMINEKLKKAEDLGEQGMVDEAQKALEEAEALKKLPARQEPVLDSTKYTADDVRITDQKLRVCDICGAFLSVYDSDRRLADHFGGKLHLGYMQIREKLAELQEERNKVRKVDRYDDRRSKERSREIERESSRDRERAGSRDRRDYDRKSRDRDRHHDRDRGYDRERERDSDRSRSYDSRSRRDRSRSRERSRDYDRHSRRYDRY

SEQ ID NO: 12919 - protein, 414 aa, Ricinus communis
MDAMRKQLDVLMGANRNGDVREVNRKYYDRDVCRMYLVGLCPHELFQLTKMDMGPCPKVHSLQLRKEYEEARAKGTDNYDRELEDVIDRLIVECDKKISRALKRLEAEDAKAAIAISVSEVTQNPEIIELSKQIKEKLKEADKHDLEGKTDFKIQALEEVEKLRTERAEKQSALLLEAFNKDRASLPQPLPNPPPLAPLPVPAPDPRTQEMINEKLKKAEDLGEQGMVDEAQKALEEAEALKKLPARQDPALDSSKYTAADVRITDQKLRVCDICGAFLSVYDSDRRLADHFGGKLHLGYMQIREKLTELQEERNKLRRGDRHDDRRSKERSKDHDRESSRDRDRAGSRDQERDYDRRSRDRDRHYDRDRAYERERDRDSDRSRSYDSRSRHRSRSRSRERARDYDRHRRYDRY

SEQ ID NO: 12920 - protein, 464 aa, Cannabis sativa
MDALRKQLDQLMGANRNGDVREVSRKYYDRDVCRLYLVGLCPHELFQLTKMDMGPCPKVHSLQLRKEYEEAKAKGTDNYDRDLEDVIDRLIVECDRKIARALKRLEDDDAKAAIAISVSDVTQTPEIIELSKQIKEKLKEADQYDLEGKTDLKIRALEVIEELRTQRADKQSMLLLDAFNKDRASLPQPLPNPPPLAPLPVAALDPRTQEMINEKLKKAEDLGEQGMVDEAQKALEEAEALKKLPARQEPVLDSTKYTAADVRITDQKLRVCDICGAFLSVYDSDRRLADHFGGKLHLGYMQIREKLAELQEERNKVRKVDRYDDRRSKERSREIERESSRDRERAGSRDRRDYDRKSRDRDRHHDRDRGYDRERERDSDRSRSYDSRSRRDRSRSRERSRDYDRHRYWLQIFPIKFPLFQMVLFLAGHLKLSNSISAGVMIGTRQILMQRRRATRGGGNLIFF

SEQ ID NO: 12921 - protein, 413 aa, Gossypium hirsutum
MDAMRKQLDVLMGANRNGDVREVNRKYYDRDVCRLFLSGLCPHELFQLTKMDMGPCPKVHSLQLRKEYEEAKSKGVDNYDRELEDAIERLIVECDRKIGRALRRLEDEDAKAAIAISVSEVTQTPEILELSKQIKEKLKETDQHDLEGKTDLKIRALEEVEELRTTRADKQSILLLDAFNKDRASLPQPLPNPPPLAPLPVAAPDPHIQEMINEKLKKAEDLGEKGMVDEAQKALEEAEALKKLPARQEPVLDSSKYTAADVRITDQKLRVCDICGAFLSVYDSDRRLADHFGGKLHLGYMQIRDKLAELQEERNKSRKLDRYDDRRSKERSRDREREPSRDRDRGESCDRGRDHDRRSRDQDRYHERDRGYDRDRERDYERSRSYDSRSRRRSRSRSREHSRDYDRHRRDRY

SEQ ID NO: 12922 - protein, 411 aa, Fragaria vesca
MDALRKQLDQLMGANRNGDVREVNRKYYDRDVCRLYLVGLCPHELFQLTKMDMGPCPKVHSLQLREEYKEARKQGTDNYDRDLEDVIDRLIVECDRKISRALKRLEDDDAKAAIAISVSEVTQTPEILELSKQIKEKLEEADRFDLEGKTDLKIRALEILEDLRGKRADKQSTLLLDAFNKDRAALPQPLPNPPPLAPLPVVVPDARTQEMINEKLKKAEDLGEQGMVDEAQKALEEAEALKKLPPRQEPVLDSSKYTAADVRITDQKLRVCDICGAFLSVYDSDRRLADHFGGKLHLGYMQIREKLAELQAEKNKIRKVDRYDERRSKERSKERDREPSRDRERGDSRDRGRDLDRRSRDRDRHYDRDRGERDRDSNRSRNYDSRSHRRSRSRSRERSKDYDRHRRYDRY

SEQ ID NO: 12923 - protein, 411 aa, Catharanthus roseus
MDAIRKQLDVLMGANRNGDVREVDRKYYDRDVCRLFLSGLCPHELFQLTKMDMGPCPKVHSLQLRKEYEESKTKGTDNYDRDLEDVIDRLIVECDRKIARALKRLDDEDAKAAIAISVSEVTQTPEVQELSKEIKEKLKEADIYDLEGKTDMKIRALEVVEELRTKRADKQSMLLLDAFNKDRASLPQPLTNAPQSAPLPATAPDPHVQEMINEKLKKAEDLGEQGMVDEAQKLLEEAEALKKLPARQEPVLDSSSKYTAADVRITDQKLRVCDICGAFLSVYDSDRRLADHFGGKLHLGYMQIREKLAELQEERNKKRKALEEERRSKERRSRDRESSRDRDRGDSRERGRDHDRRSRDRDRDRGYDRDRERERDGDRSRSYNSRSHRRSRSRSRERSRDYDRHRRSDRY

SEQ ID NO: 12924 - protein, 413 aa, Cucumis melo
MDAFRRQLDQLMGANRNGDVQEVSRKYYDRDVCRMFLVGLCPHELFQLTKMDMGPCPKIHSLQLRKEYEEGKAKGIHNYDRDLEDVIDRLIIECDRKIARALKRLEEEDAKAAIAISVSEVTQIPEVLELSKEIKEKLKEADQYDLEGKTDLKIRVLEVVEELRTRRADKQSMLLLDAFNKDRASLPQPLPNPPPLAPLPVVAPDPRTQEMINEKLKKAEELGEQGMIDEAQKALEEAEALKKLPARQEPVVDSSKYTAADVRITDQKLRVCDICGAFLSVYDSDRRLADHFGGKLHLGYMQIREKLAELQEERNKSRKVDRHDDRRSKERSREPDREPSRDRDRGDSRDRGRDNDRRSRDRDRYHDRDRYDRERNRDPDRSYDSRSRRRSRSRSTDRERARDYDRHKRRDRY

SEQ ID NO: 12925 - protein, 413 aa, Citrullus lanatus
MDAFRRQLDQLMGANRNGDVQEVSRKYYDRDVCRMFLVGLCPHELFQLTKMDMGPCPKIHSLQLRKEYEEGKTKGIHNYDRDLEDVIDRLIIECDRKIARALKRLEEEDAKAAIAISVSEVTQIPEVLELSKEIKEKLKEADQYDLEGKTDLKIRVLEVVEELRTKRADKQSMLLLDAFNKDRASLPQPLPNPPPLAPLPVVAPDPRTQELINEKLKKAEELGEQGMIDEAQKALEEAEALKKLPARQEPVMDSSKYTAADVRITDQKLRVCDICGAFLSVYDSDRRLADHFGGKLHLGYMQIREKLAELQEERNKSRKVDRHDDRRSKERSREPDREPSRDRDRGDSRDRGRDNDRRSRDRDRYHDRDRYDRERNRDPDRSYDSRSRRRSRSRSTDRERARDYDRHKRRDRY

SEQ ID NO: 12926 - protein, 428 aa, Malus domestica
MDALRKQLDQLMGANRNGDVREVNRKYYDRDVCRLYLVGLCPHELFQLTKMDMGPCPNVHSLQLRKEYEEAKAKGTDNYDRDLEDVIDRLIVECDRKITRALKRLEDDDAKAAIAISVSEVTQTPEILELSKQIKEKLKEVDQYDLEGKTDLKIRALEIVEELRGIRADKQSTLLLDAFNKDRAALPQPLPNPPPLAPLPVVVPDARTQEMINEKLKKAEDLGEQGMVDEAQKALEEAEALKKLPARQEPIVDSSKYTAADVRITDQKLRVCDICGAFLSVYDSDRRLADHFGGKLHLGYIQIREKLAELQEEKNKSRKVDRSDDRRSKERSMECDRESSRDRERGASRDRGRDYDRRSRDRDRYYDRDRGYDRDRDRDSDRSHNYDSRSRRRSRSRSRERSRDYDRHRCVLFRGGRFLVSSIYFTCN

SEQ ID NO: 12927 - protein, 417 aa, Cucurbita pepo
MDAFRKQLDQLMGANRNGDVQEVSRKYYDRDVCRMFLVGLCPHELFQLTKMDMGPCPKIHSLQLRKEYEEAKTKGVHNYDRDLEDVIDRLIIECDRKIARALKRLEEEDAKAAIAISVSEVTQIPEVLELSKQIKEKLKEADQYDLEGKTDLKIRVLEVVEELRTLRADKQSMLLLDAFNKDRASLPQPMPNPPPLAPLPVVAPDPRTQEMINEKLKKAEELGEQGMIDEAQKALEEAEALKKLPARQEPVMDSSKYTAADVRITDQKLRVCDICGAFLSVYDSDRRLADHFGGKLHLGYMQIREKLAELQEERNKSRKIDRHDDQRSKERSREPDREPSRDRDRDRDRADSRDRGRDNDRRSRDRDRYNDRDRYDRDRNRDPDRSYDSRSRRHSRSRSTDRERSRDYDRHKRRDRY

SEQ ID NO: 12928 - protein, 416 aa, Tabernaemontana elegans
MDAIRKQLDVLMGANRNGDVREVDRKYFDRDVCRLFLSGLCPHELFQLTKMDMGPCPKVHSLQLRKEYEEAKAKGVDNYDRDLEDVIDRLIIECDRKIARALKRLDDEDAKAAIAISVSEVTQTPEIQELSKEIKEKLKEADIHDLEGKTDMKIRALEVVEDLRTKRADKQSMLLLDAFNKDRASLPQPLTNTPQLAPLPATAPDPRVQEMINEKLKKAEDLGEQGMVDEAQKLLEEAEALKKLPARQEPAQDTSSKYTAADVRITDQKLRVCDICGAFLSVYDSDRRLADHFGGKLHLGYMQIREKLSELQEERNKKRKAYEEERRSKERRSRDRESSRDKDRGNSREQARDHDRRSRDRDRHYDRDRGYDRERERERDRDRDRSRSYDSRSRRRSRSRSQERSRDYDRHRSDRY

SEQ ID NO: 12929 - protein, 210 aa, Panax ginseng
MDALRKQLDVLMGANRNGDVREVNRKYYDRDVCRLFLVGLCPHELFQLTKMDMGPCPKVHSLQLRKEYEESKVKGQDNYDRELEDVIDRLIVECDRKIARALKRLTDEDAKAAIAISVSEVTMTPDILELSKEIKEKLKEVDQHDLEGKTDMKIRALEVLEELRTKRADKQSMLLLDAFNKDRASLPQPLPNPPPLAPFLWLFLMLAHRR

SEQ ID NO: 12930 - protein, 407 aa, Panax ginseng
MDALRKQLDVLMGANRNGDVREVNRKYYDRDVCRLFLVGLCPHELFQLTKMDMGPCPKVHSLQLRKEYEESKVKGQDNYDRELEDVIDRLIVECDRKIARALKRLTDEDAKAAIAISVSEVTMTPEILELSKEIKEKLKEVDQHDLEGKTDMKIRALEVLEELRTKRADKQSMLLLDAFNKDRASLPQPLPNPPPLAPLPVVVPDARTQEMINEKLKKAEDLGEQGMVDEAQKALEEAEALKKLPVLRQEPVLDSSKYTAADVRITDQKLRVCDICGAFLSVYDSDRRLADHFGGKLHLGYMQIREKLADLKDERDNKRKASEELIRSKERSRDHDREGSRDRDRGGSRERARDHDRRSKDRDRGYDRDREREGDRYRSYDSRSRQRSRSRERARGYDRHSRRYDRH

SEQ ID NO: 12931 - protein, 289 aa, Trifolium pratense
RKQLAVLMGANRNGDVREVNRKYYDRDVCRLYLVGLCPHELFQLTKMDMGPCPKVHSLQLRKEYEEAKSKGIDNYERELEDVIDKLIGECDRKIGRALKRLEDDDAKAAIAISVSEVTQTPEVLELAKEIKEKLKEADKYDLEGLSDMRIRALEIVEELRIKRADKQSTLLLDAFNKDRASLPQPLPNPPPLAPLPVVTPDARTQEMINEKLKKAEDLGEQGLIDEAQKALEEAEALKKLPSRQEPALDSSKYTAADVRITDQKLRVCDICGAFLSVYDSRLLCQFYEG

SEQ ID NO: 12932 - protein, 338 aa, Cirsium arvense
MDAIRKQLDVLMGANRNGDVREVNRKYYDRDVCRLFLVGLCPHELFQLTKMDMGPCPKVHSFQLRKEYQEAKSKGQDNYDRELEDVIDRLIVECDRKIARALKRLSEEDAKAAIAISVSEVTQTPEILELSKQIKEKLKEADQHDLEGKADMKIRALEMVEELRTQRADKQSMLLLDAFNKDRASLPQPLANPPPLAPLPLATPDARTQELINEKLKKAEDLGEQGMVDEAQKALEEAEALKKLSMQLPPRQEPVTDSSKYTAADVRVTDQKLRVCDICGAFLSVYDSDRRLADHFGGKLHLGYMQIREKLADLQDERNNKRKPIEDDRRSKRKKQGY

SEQ ID NO: 12933 - protein, 419 aa, Aristolochia fimbriata
MDAMRKQLDVLMGANRNGDVREVNRKYYDRDVCRLFLVGLCPHELFQLTKMDMGPCPKVHSLQLRKEYEEAKAKGVHNYDRELEDVIDKLIIECDRKIQRALKRLEDEDAKAAIAISVSEVTQSPEVLELSKQIKEKLKEADAFDLEGKTDNKIRALEVVEELRARRADKQSMLLLDAFNKDRASLPQPLPNPPPLAPLPVLAPPDARTQEMIKEKLKNAEDLGEQGLVDEAQKALEEAEALKKLAQRQEPVLDGSKYTPVDVRITDQKLRVCDICGAFLSVYDSDRRLADHFGGKLHLGYMQIREKLAELQEERNKSRKQAEEERRSKERSRERERGASRDRERDREDHGTREKPRDYNRRSRDYDRSYDRDRGYDRDREKDRSRSYDSRSHRRSRSRSRECSRDYDRNRRHDRYDRH

SEQ ID NO: 12934 - protein, 415 aa, Euphorbia peplus
MDAMRKQLDVLMGANRNGDVREVNRKYYDRDVCRMYLVGLCPHELFQLTKMDMGPCPKVHSLQLRKEYEGARAKGTDNYDRELEDVIDRLIVECDKKISRALKRLEADDAKAAIAISVSEVTQNPEIIELSKQIKEKLKEADRHDLEGKTDYKIQTLEEVEKMRSERAEKQSALLLEAFNKDRASLPQPLPNPPPLAPLPVHTPDPRTQEMINEKLKKAEDLGEQGMVDEAQKALEEAEALKKLPARPDPALDSSKYTAADVRITDQKLRVCDICGAFLSVYDSDRRLADHFGGKLHLGYMQIREKLAELQEERNKPRRADRPDDQRPKERSREREREPSKDRDRADSRDRERDHDRRSRDRGDRHHDRDRGYDRERERDSDRSRGYDSRSRHRSRSRSRERSRDYDRHRRYDRY

SEQ ID NO: 12935 - protein, 404 aa, Nicotiana tabacum
MDAIRKQLDVLMGANRNGDVTEVDRKYYDREVCRLFLSGLCPHELFQLTKMDMGPCPKVHSLQLRKEYVEAKEKGQDNYDRDLEDAIDRLIVECDRKITRALKRLDEEDAKAAIAISVSEVTLTPEIDELSKQIKEKLKEADVYDLEGKTDMKIRALEEVEELRTKRADKQSMLLLDAFNKDRASLPQPLQNGPQLAPLPAAAPDPRIQEMINEKLKKAEDLGEQGMVDEAQKALEEAEALKKLPVRQDPGQDSSKYTAVDVRITDQKLRVCDICGAFLSVYDSDRRLADHFGGKLHLGYMQIREKLAELQEERNKKRKAIEEDRRSKERKSRERDRESSRDRVDSREAGRDHDRRSKDRSYDRERDRNRDRSRNYDSRSHRRSRSRSRERSRDYDRHRRYDRY

SEQ ID NO: 12936 - protein, 420 aa, Centaurea maculosa
MDAIRKQLDVLMGANRNGDVREVNRKYYDRDVCRLFLVGLCPHELFQLTKMDMGPCPKVHSFQLRKEYQEAKAKGQDNYDRELEDVIDRLIVECDRKIARALKRLSEEDAKAAIAISVSEVTQTPEILELSKQIKEKLKEADQYDLEGKADMKIRALETVEELRTQRADKQSMLLLDAFNKDRASLPQPLANPPPLAPLPLATPDARTQELINEKLKKAEDLGEQGMVDEAQKALEEAEALKKLSMQLPPRQEPVTDSSKYTAADVRVTDQKLRVCDICGAFLSVYDSDRRLADHFGGKLHLGYMQIREKLADLQEERNNKRKPVEDDRRSKERSRDPEREGSRDRDRASSRDRARDHDRRSRDRDRHHDRGRGYDRYDRDRERERDRSRSYDSRSRHRSRSHSRERPRDYDRQRRYDRY

SEQ ID NO: 12937 - protein, 420 aa, Centaurea maculosa
  misc_feature (268)..(268): Xaa can be any naturally occurring amino acid
MDAIRKQLDVLMGANRNGDVREVNRKYYDRDVCRLFLVGLCPHELFQLTKMDMGPCPKVHSFQLRKEYQEAKAKGQDNYDRELEDVIDRLIVECDRKIARALKRLSEEDAKAAIAISVSEVTQTPEILELSKQIKEKLKEADQYDLEGKADMKIRALETVEELRTQRADKQSMLLLDAFNKDRASLPQPLANPPPLAPLPLATPDARTQELINEKLKKAEDLGEQGMVDEAQKALEEAEALKKLSMQLPPRQEPVTDSSKYTAADVRXTDQKLRVCDICGAFLSVYDSDRRLADHFGGKLHLGYMQIREKLADLQEERNNKRKPVEDDRRSKERSRDPEREGSRDRDRASSRDRARDHDRRSRDRDRHHDRGRGYDRYDRDRERERDRSRSYDSRSRHRSRSHSRERPRDYDRQRRYDRY

SEQ ID NO: 12938 - protein, 420 aa, Cirsium arvense
MDAIRKQLDVLMGANRNGDVREVNRKYYDRDVCRLFLVGLCPHELFQLTKMDMGPCPKVHSFQLRKEYQEAKAKGQDNYDRELEDVIDRLIVECDRKIARALKRLSEEDAKAAIAISVSEVTQTPEILELSKQIKEKLKEADQYDLEGKADMKIRALETVEELRTQRADKQSMLLLDAFNKDRASLPQPLANPPPLAPLPLATPDARTQELINEKLKKAEDLGEQGMVDEAQKALEEAEALKKLSMQLPPRQEPVTDSSKYTAADVRVTDQKLRVCDICGAFLSVYDSDRRLADHFGGKLHLGYMQIREKLADLQEERNNKRKPIEDDRRSKERSRDPEREGSRDRDRASSRDRARDHDRRSRDRDRHHDRGRGYDRYDRDRERERDRSRSYDSRSRHRSRSHSRERPRDYDRQRRYDRY

SEQ ID NO: 12939 - protein, 401 aa, Panax ginseng
DVLMGANRNGDVREVNRKYYDRDVCRLFLVGLCPHELFQLTKMDMGPCPKVHSLQLRKEYEESKVKGQDNYDRELEDVIDRLIVECDRKIARALKRLTDEDAKAAIAISVSEVTMTPDILELSKEIKEKLKEVDQHDLEGKMDMKIRALEVLEELRTKRADKQSMLLLDAFNKDRASLPQPLPNPPPLAPLPVVVPDARTQEMINEKLKKAEDLGEQGMVDEAQKALEEAEALKKLPVLRQEPVLDSSKYTAADVRITDQKLRVCDICGAFLSVYDSDRRLADHFGGKLHLGYMQIREKLADLKDERDNKRKASEELIRSKERSRDHDREGSRDRDRGGSRERARDHDRRSKDRDRGYDRDREREGDRSRSYDSRSRRRSRSRSRERARGYDRHSRRYDRY

SEQ ID NO: 12940 - protein, 407 aa, Euonymus alatus
MDAMRKQLDVLMGANRNGDVREVNRKYYDRDVCRLYLAGLCPHELFQLTKMDMGPCPKVHSLQLRKEYEEARAKGLDNYDRDLEDVIDRLIVECVKKIGRALKRLEDDDAKAAIAISVSEVTQTPEVLELSKQIKEKLKQADQYDLEGKMDLKVRALEIIDELRTKRADKQSILLLDAFNKDRASLPQPLANAPQLAPLPVPAPDAHTQEMINEKLKKAEDLGEKGMVDEAQKALEEAEALKKLPSRQEPPLDSSKYTAADVRITDQKLRVCDICGAFLSVYDSDRRLADHFGGKLHLGYIQIREKLSELQEERNKSRKVDQHDDRRSKERSRERESEPSKDRDRGDSRDRVRDNDRKSRDRDRRYDHDRDYERPRNYDSRSRRRSRSRSRERSRDYDRHRRYDRHH

SEQ ID NO: 12941 - protein, 416 aa, Lactuca sativa
MDAIRKQLDVLMGANRNGDVREVNRKYYDRDVCRLFLVGLCPHELFQLTKMDMGPCPKVHSFQLRKEYQEAKAKGQDNYDRELEDVIDRLIVECDRKIARALKRLSEEDAKAAIAISVSEVTQTPEIFELSKQIKEKLKEADQNDLEGKADMKIRALEMVEELRTQRADKQSMLLLDAFNKDRASLPQPLPNPPPLAPLPVATPDARTQELINEKLKKAEDLGEQGMVDEAQKALEEAEALKKLSMHLPPRQEPVTDSSKYTAADVRVTDQKLRVCDICGAFLSVYDSDRRLADHFGGKLHLGYMQIREKLADLQEERNNKRKAPEEDRRSKERIREVEREGSRDRDRDRAGSRERARDHDRRSRDRHNNDRDRERDRGYDRDRSRSYDSRSRHRSRSRSRERARDYDRQRRYDRH

SEQ ID NO: 12942 - protein, 404 aa, Nicotiana benthamiana
MDAIRKQLDVLMGANRNGDVTEVDRKYYDREVCRLFLSGLCPHELFQLTKMDMGPCPKVHSLQLRKEYVEAKEKGQDNYDRDLEDAIDRLIVECDRKITRALKRLDEEDAKAAIAISVSEVTLTPEIDELSKQIKEKLKEADVYDLEGKTDMKIRALEEVEELRTKRADKQSMLLLDAFNKDRASLPQPLQNGPQLAPLPAAAPDPRIQEMINEKLKKAEDLGEQGMVDEAQKALEEAETLKKLPVRQDPGQDSSKYTAVDVRITDQKLRVCDICGAFLSVYDSDRRLADHFGGKLHLGYMQIREKLAELQEERNKKRKAIEEDSRSKERKSRERDRESSRDRVDSREAGRDHDRRSKDRSYDRERDRNRDWSRNYDSRSHRRSRSRSRERSRDYDRHRRYDRY

SEQ ID NO: 12943 - protein, 413 aa, Populus trichocarpa
MDAMRKQLDVLMGANRNGDVREVNRKYYDRDVCRLYLVGLCPHELFQLTKMDMGPCPKVHSLQLRKEYEESTGKGVDNYEIELENVIDKLIVECDKKIGRALKRLEDEDAKAAIAISVTEVTQNAEVSELSKLIKEKLKEVDKYDLEGKTDFKIQVLEEVEKLRTERAEKQSALLLEAFNKDRASLPQPMLTPPPPPPPMPLPTPDPRTQEMINEKLKKAEDLGEQGMVDEAQKALEEAEALKKLPARQEPSADSSKYTAADVRITDQKLRVCDICGAFLSVYDSDRRLADHFGGKLHLGYMQIREKLTELQENKQRKVDRHDDQRSRERSRDRDREPSRDRDRGDSRDRGREYDRKSRDRDRYNDRDRGYDRERDRGSERSRNYDSRSRRRSRSRSREHSRDYDHHRRFDRY

SEQ ID NO: 12944 - protein, 424 aa, Elaeis guineensis
MDAIRKQLDVLMGANRNGDVMEVKRKYYDRDVCRLYLAGLCPHDLFQLTKMDMGPCPKVHSLQLRKEYEEAKAKGIHNFDRELEDMIERLIVECERKIQRALKRLEEEDAKAAIAISVSEVTQTPEVMELSKQIKEKLKEADAFDLEGKTDSKIRALEEVEELRTKRADKQSMLLLDAFNKDRASLPQPLQNPSQLSSTPAPIPPDPRTQEMINEKLRKAEELGEKGMVDEAQKALEEAEALKKLGARQEPVLDSSKYTAADVRITDQKLRVCDICGAFLSVYDSDRRLADHFGGKLHLGYMQIREKIAELQEERNKRRKSERTEYDSRSRERSQDRDRAASRDRDRDREDRGDSRDRGRDYDRRSRDYDRHYDRDRGYDRDRERESDRSRSYDSRSRRRSRSRSKERSRDYDRHRRHDRYDRY

SEQ ID NO: 12945 - protein, 424 aa, Elaeis guineensis
MDAIRKQLDVLMGANRNGDVREVNRKYYDRDVCRLFLAGLCPHDLFQLTKMDMGPCPKVHSLQLRKEYEEAKAKGIHNFDRELEDLIERLIVECERKIQRALKRLEDEDAKAAIAISVSEVTQTAEVMELSKQIKEKLKEVDAFDLEGKTDSKIRALEELEELRTKRADKQAMLLLDAFNKDRASLPQPLQNLPQSSSTPVLVPPDPRTQEMINEKLKKAEELGEKGMVDEAQKALEEAEALKKLGARQEPGLDSSKYTAADVRITDQKLRVCDICGAFLSVYDSDRRLADHFGGKLHLGYMQIREKLAELQEERNKRRKLDRSEYDRRSRERSQDCDRAASRDRDRDRDDRGDNRDRGRDYDRRSRDYDRHYDRDRGYDRERDRESDRSRSHDSRSRRRSRSHSRERSRDYDRHRHHDRYDRY

SEQ ID NO: 12946 - protein, 400 aa, Solanum lycopersicum
MDAIRKQLDVLMGANRNGDVTEVDRKYYDREVCRLYLSGLCPHELFQLTKMDMGACPKVHSLPLRKEYEEAKAKGQDNYDRDLEDLIDRLIVECDRKITRALKRLDEEDAKAAIAISVSEVTLTPEIDELSKQIKEKLKEADIHDLEGKTDMKIRALEEVEELRTKRADKQSMLLLDAFNKDRASLPQPLQNAPQLAPLPASTPDPRIQEMINEKLKKAEDLGEQGMVDEAQKALEEAEALKKLPVRQEPVQDSSKYTAVDVRITDQKLRVCDICGAFLSVYDSDRRLADHFGGKLHLGYMQIREKLAELQEERNKKRKAIEEDRRSKERKSRERERESSRDRVDNRDHDRRSKDRSYDRERDRNRDRSRNYDSRSHRRSRSRSRERSRDYDRHRRHDRY

SEQ ID NO: 12947 - protein, 417 aa, Chenopodium quinoa
MDAIRKQLDVLMGANRNGDVTEVNRKYFDRDVCRLFLSGLCPHELFQLTKMDMGPCPKVHSLQLRKEYEDAKAKGVDNYDRDLEDVIDRLIVECDRKITRALKRLADEDAKAAIAISVSDVTQTEEIIELSKQIKEKLKEADQSDLEGKTDLKIRALEEVEELRTSRADKQSMLLLDAFNKDRASLPQPLPNPPPLAPLPMLAPDARTQELINEKLKKAEDLGEQGMVDEAQKALEEAEALKRLAPRPDPSADPAKYTAADVRITDQKLRVCDICGAFLSVYDSDRRLADHFGGKLHLGYMQIREKLAELQEEKNKKRKVHEEDRRSRERSREVERAPSKDRERGDSQQRDYDRRSRDRDRHSDRDRGYDRERERDRERSRSHDSRSRRRSRSRSRERSRDYGRDYDRSRRHDRDRY

SEQ ID NO: 12948 - protein, 416 aa, Flaveria ramosissima
MDAIRKQLDVLMGANRNGDVTEVNRKYYDRDVCRLFLVGLCPHELFQLTKMDMGPCPKIHSFQLRKEYQEAKSKGEDNYDRELEDVIDRLIVECDRKIARALKRLSEEDAKAAIAISVSEVTQTPEILELSKQIKEKLKEADQYDLEGKADMKIRTLEMIEELRTQRADKQSMLLLDAFNKDRASLPSPLPNPPPLAPLPVPNPDARTQELINEKLKKAEDLGEQGMLDEAQKALEEAEALKKLSIHLPPRPEPVTDSSKYTAADVRVTDQKLRVCDICGAFLSVYDSDRRLADHFGGKLHLGYMQIREKLADLLEERNNRRKAPEDDRRSKERSKDLEREGSRDRDRASSRDRDRTRDSDRRSRDRDRHHDRGRGYDRYDRDRERDRDSRSRHRSRSRSRDRVRDYDRPRRYDRY

SEQ ID NO: 12949 - protein, 414 aa, Helianthus annuus
MDAIRKQLDVLMGANRNGDVTEVNRKYYDRDVCRLFLVGLCPHELFQLTKMDMGPCPKVHSFQLRKEYQEAKAKGQDNYERELEDVIDRLIVECDRKIARALKRLSEEDAKAAIAISVSEVTQTPEILELSKQIKEKLKEADQYDLEGKVDMKIRAMEMVEELRTQRADKQSMLLLDAFNKDRASLPQPLPNPPPLAPLPVANPDARTQELINEKLKKAEDLGEQGMLDEAQKALEEAEALKKLSMHFPPRQEPVTDSSKYTAADVRVTDQKLRVCDICGAFLSVYDSDRRLADHFGGKLHLGYMQIREKLADLLEERTNKRKVPEDDRRSKERSKDLEREGSRDRVRASSRDRDRVRDSDRRSRDRDRHQDRDRGYDRYDRDRERDRDSRSRHRSRSRDRVRDYDRPRRYDRY

SEQ ID NO: 12950 - protein, 288 aa, Ambrosia trifida
MDAIRKQLDVLMGANRNGDVTEVNRKYYDRDVCRLFLVGLCPHELFQLTKMDMGPCPKVHSFQLRKEYQEAKSKGQDNYDRELEDVIDRLIVECDRKIARALKRLSDEDAKAAIAISVSEVTQTPEIHELSKQIKEKLKEADQYDLEGKVDMKIRAMEVVEELRTQRADKQSMLLLDAFNKDRASLPQPLPNPPPLAPLPVATPDARTQELINEKLKKAEDLGEQGMLDEAQKALEEAEALKKLSVHLPPRQEPVTDSSKYTAADVRVTDQKLRVCDICGVFFKCLRQ

SEQ ID NO: 12951 - protein, 414 aa, Flaveria ramosissima
MDAIRKQLDVLMGANRNGDVTEVNRKYYDRDVCRLFLVGLCPHELFQLTKMDMGPCPKVHSYQLRKEYQEAKSKGQDNYDRELEDVIDRLIVECDRKIARALKRLSEEDAKAAIAISVSEVTQTPEILELSKQIKEKLKEADQYALEGKADMKIQALEMVEELRTQRADKQSMLLLDAFNKDRASLPQPLPNPPPLAPLPVANPDARTQELINEKLKKAEDLGEQGMLDEAQKALEEAEALKKLSMQLLPRQEPVTDSSKFTAADVRVTDQKLRVCDICGAFLSVYDSDRRLADHFGGKLHLGYMQIREKLADLLEERTNKRKASEDDRRSKERSKDLEREGSRDRVRASSRDRDLSRDSDRRSRDRDRHHDRDRGYDRYDRDRGRDRDSRSRHRSRSRDRVRDYDRPRRYDRY

SEQ ID NO: 12952 - protein, 335 aa, Theobroma cacao
MDAMRKQLDVLMGANRNGDVREVNRKYYDRDVCRLFLSGLCPHELFQLTKMDMGPCPKVHSLQLRKEYEEAKAKGVDNYDRELEDAIDRLIVECDRKIGRALKRLEDEDAKAAIAISVSDVTQTPEVLELSKQIKEKLKEADQHDLEGKTDLKIRALEEVEEFRTKRADKQSMLLLDAFNKDRASLPQPLPNPPALAPLPVPAPDPRTQEMINEKLKKAEDLGEKGMVDEAQKALEEAEALKKLPARQEPVLDSSKYTAADVRITDQKLRVCDICGAFLSVYDSDRRLADHFGGKLHLGYMQIRDKLAELQVSVMVYGLLIYAYHQKISLIVLMV

SEQ ID NO: 12953 - protein, 416 aa, Echinacea purpurea
MDAIRKQLDVLMGANRNGDVTEVNRKYYDRDVCRLFLVGLCPHELFQLTKMDMGPCPKIHSPQLRKEYQEAKSKGQDNYDRELEDVIDRLIVECDRKIARALKRLSEEDAKAAIAISVSEVTQTPEILELSKQIKEKLKEADQYDLDGKVDMKIRALETVEELRTQRADKQSMLLLDAFNKDRASLPSPLPNPPALAPLPVPNPDARTQELINEKLKKAEELGEQGMLDEAQRALEEAEALKKLSMHLPPRQEPVTDSSKFTAADVRVTDQKLRVCDICGAFLSVYDSDRRLADHFGGKLHLGYMQIREKLADLLEERTNRRKAPEEDRRSKERSKDLEREGSRDRDRASSRDRDRTRDSDRRSRDRDRHHDRGRGYDRHERDRERDRDSRSRHRSRSRSRDRVRDYDRPRRYDRY

SEQ ID NO: 12954 - protein, 414 aa, Sesamum indicum
MDALRKQLDVLMGANRNGDAQEVTRKYYDRDVCRLFLAGLCPHELFQLTKMDKGPCPKVHSLQLRKEYEEAKAKGLDNYDRDLEDNIDRLIIECDRKIARALKRLDEEDAKAAIAISVSEVTQTPEIIELSKQIKAKLKEADQADLEGKTDVKIRALEEVEELRTKRADKQSMLLLDAFNKDRASLPQPVTNASQTPMPAAVPDPRIQEMINEKLKKAEDLGEQGMVDEAQKALEEAEALKKLPARQEPVLDSSKYTAADVRITDQKLRVCDICGAFLSVYDSDRRLADHFGGKLHLGYMQIREKLAELQEERDKKRKAYEEERRPRDRRSRDRDRESSKDLGRGDSHERGRDYDRRSRDRDRHPDRERDYDRERERDRERSRSYDSRSHRKSRSRSRERSRDYDRYSRRYDRY

SEQ ID NO: 12955 - protein, 413 aa, Vinca minor
MDSIRKQLDVLMGANRNGDVTEVDRKYFDRDVCRLFLSGLCPHELFQLTKMDMGPCPKVHSLQLRKEYEESKAKGVDSYDRDLEDVIDRLIIECDRKIARALKRLDDEDAKAAIAISVSEVTQTPETQELSKEIKQKLKEVDIYDLEGKTDMKIRALEVLEELRTKRADKQSILLLDAFNKDRALLPQPLTNNPQLAHVPETAPDPRVQEMINEKLKKAEDLGMEGMVDEAQKLLEEAEALKKLPARQEPAPDSSSKYTAADVRITDQKLRVCDICGAFLSIYDSDRRLADHFGGKLHLGYMQIREKLAELQEERNKKRKACEEERRSKERKSLDREPSKDRDRGDGRERVRDHDRRSRDRDRYNERDRGYNRERERDRDRSRSYDSRSRRRSRSRSQENSRDYDRRRRSDRY

SEQ ID NO: 12956 - protein, 420 aa, Arnica chamissonis
MDAIRKQLDVLMGANRNGDVTEVNRKYYDRDVCRLFLVGLCPHELFQLTKMDMGPCPKVHSFHLRKEYQEAKSKGQDNYDRELEDVIDRLIVECDRKIARALKRLSEEDAKAAIAISVSEVTQTPEILELSKQIKEKLKEADQCDLEGKADMKIRALEVVEELRTQRADKQSMLLLDAFNKDRASLPSPLPNPPSLAPLPVPTPDARTQELINEKLKKAEDLGEQGMLDEAQKALEEAEALKKLSMHFPPRQEPVTDSSKYTAADVRVTDQKLRVCDICGAFLSVYDSDRRLADHFGGKLHLGYMQIREKLADLLDERNNKRKAPEDDRRSKERSKDLEREGSRDRAGSRDRASSRDRDRTRDSDRRSRDLDRHHDRGRGYDRYDRDRERDRDSRSRHRSRSRSRDRVRDYDRPRRYDRY

SEQ ID NO: 12957 - protein, 417 aa, Aquilegia formosa
MDALRKQLDVLMGANRNGDVTEVNRKYYDRDVCRLFLAGLCPHELFQLTKMDMGPCSKIHSLQLRKDYNDAKAKGGHNFDRELEDVIDRLIVECDRKIARALKRLEDADAKAAIAISVSEVTQTPEVLELSKQIKEKLKEVDQLDFEGETDGKIRAMEVVEDLRTKRADKQSVLLLDAFNKDRASLPQPLLNPPPLAPLPVYAPPDPHTQEMINEKLKKAEDLGEQGMVDEAQKALEEAEALKKLGARQEAVLDSSKYTAADVRITDQKLRVCDICGAFLSVYDSDRRLADHFGGKLHLGYMQIREKLAELQEEREAGRKVARTEDDRRSKERLQDHERASSRDRARDREDRGGSRERRRESDRNSDRNRYYDRDRGYDRERERDRSRSHDSRSRKRSRSRSRDRSRDHGHRRHDRY

SEQ ID NO: 12958 - protein, 411 aa, Linum usitatissimum
MDAMRKQLDVLMGANRNGDVREVNRKYFDRDVCRMYLVGLCPHELFQLTKMDMGPCPKVHSLQLRKEYEEARAKGVDNYDRELEDVIDRLIVECDKKIGRALKRLDDEDDAKAAIAISVSEVTQTPEVIELSRQIREKLKEVDKHDLEGKTDSKIQTLEEVEKLRSERAEKQSALLLEAFNKDRASLPQPLPNPPPLAAMPAAAPDPRTQEMINEKLKKAEDLGEKGMVDEAQKALEEAEALKKLPARQDPTVDNSKYTAADVRITDQKLRVCDICGAFLSVYDSDRRLADHFGGKLHLGYIQIREKIAELQEEKNKFRNVERNDERRSKDRSKEADREPSRDRDRGNSRDRGSDRGSRDYDRRSRDRDRYHDRERDRDSDRSRGYERSRRRSRSQERSRDYDRHRRHDRH

SEQ ID NO: 12959 - protein, 404 aa, Eutrema halophilum
MDAMRKQLDVLMGANRNGDVTEVNRKYYDRDVCRLYLSGLCPHELFQLTKMDMGPCPKVHSLQLRKEYKEAKAKGVDNYDRELEDAIDRLIVECDRKIGRALKRLQEEDAKAAIAISVTEVTQSPEILELSKQIKEKMKEADLHDLEGKTDLKIRALELVEEMRTKRADLQAVLLLEAFNKDRASLPQPIPAQPPAAALPPPDPRTQEMINEKLKKAEEFGEQGMVDEAQKALEEAEALKKLTARQEPVVDSTKYTAADVRITDQKLRLCDICGAFLSVYDSDRRLADHFGGKLHLGYMLIRDKLAELQEEKNKVHKERVEERRSKERSRERESSKDRDRGDSRDRGRDLDRRSRDRDRHHDHREHDRNYNQSRGYDSRSRRSSRSRSRERPRDYDRRRRHDRY

SEQ ID NO: 12960 - protein, 333 aa, Chenopodium quinoa
MDAFRKQLDVLMGANRNGDVTEVNRKYFDRDVCRLFLSGLCPHELFQLTKMDMGPCPKVHSLQLRKEYEEAKAKGVDNYDRDLEDVIDRLIVECDRKITRALKRLADEDAKAAIAISVSDVTQTEEIIELSKQIKEKLKEADQSDLEGKTDLKIRALEEVEELRTTRADKQSMLLLDAFNKDRASLPQPLPNPPPLAPLPMLSPDARTQELINEKLKKAEDLGEQGMVDEAQKALEEAEALKRLAPRPDPSADPAKYTAADVRITDQKLRVCDICGAFLSVYDSDRRLADHFGGKLHLGYMQIREKLAELQGRKNRSARFMKKIEGLESAAVK

SEQ ID NO: 12961 - protein, 410 aa, Orobanche aegyptiaca
MDALRKQLDVLMGANRNGDSQEVTRKYYDRDVCRLFLAGLCPHELFQLTKMDKGPCPKVHSLQLRREYEEAKAKGLDNYDRDLEDNIDRLIVECDRKIARALRRLDEEDAKAAIAISVSEVTQTPEMIELSKQIKEKMKEADQSDLEGQTDTKIRALEEVEEMRTKRADMQAMLLLDAFNKDRASLPQPLVNAPQATPLPAAVPDQRIQEMINEKLKKAEDLGEQGMVDEAQKALEEAEALKKLPARLEPVLDSSKYTAADVRITDQKLRVCDICGAFLSVYDSDRRLADHFGGKLHLGYMLIRDKLAELQEERDKIRKAHEEERRSRDRKSHDRGRESKDRDRGDSRERGRDYDRRSRDRDRHYDYDRERERDRDRSRNYDSRSHRRSRSRSRERSRDYDRHSRRYDHY

SEQ ID NO: 12962 - protein, 293 aa, Panax ginseng
MDALRKQLDVLMGANRNGDVREVNRKYYDRDVCRHFLVGLCPHELFQLTKMDMGPCPKVHSLQLRKEYKESRAKGQDNYERELEDIIDRLIIECDRKIARALKRLTDEDAKAAIAISVSEVTTTPEVLELSKEIKEKLKEADHHDLEGKTDMKIRALEVVEELRTKRADKQSMLLLVAFNKDRASLPQPLPNPPPLAPFPVVVPDARTQEMINEKLKKAEDLGEQGMVDEAQKALEEAEEIKKLPGIRQEPVLDSSKYTAADVRITDQKLRVCDICGAFLSIYDRLLGPVLRG

SEQ ID NO: 12963 - protein, 429 aa, Amborella trichopoda
MDALRKQLDVLMGANRNGDVREVNRKYYDRDVCRLFLSGLCPHELFQLTKMDLGPCPKVHSLQLRKEYEEAKAKGTDNYDRDLEDQIERLIVECDRKITRALKRLEDEDAKAAIAISVSEVTQSPEVLELSKQIKEKLKEVDTLDLEGKTDSKIRALEVVEELRAKRADKQSMLLLDAFNKDRASLPQPLQNPPSLAPLPVPLPPDPRTQEMINEKLKKSEELGELGMVDEAQKALEEAEALKKLSARQEPVVDSAKYTAADVRITDQKLRVCDICGAFLSVYDSDRRLADHFGGKLHLGYMQIREKLGELQEERNKSRKSDRAEDDRRSRGQSRDHETGGSRDRDRERDERGGSRDRGRDRDRRGRDGDRGYDRGRNYDREREREADRSRINDLRSRKRSRSRSKERSRDYDRERSDRHRRYDRYNRY

SEQ ID NO: 12964 - protein, 412 aa, Artemisia annua
MDAIRKQLDVLMGANRNGDVTEVNRKYYDRDVCRLFLVGLCPHELFQLTKMDMGPCPKVHSFQLRKEYQEAKAKGQDNYDRELEDVIDRLIVECDRKIARALKRLSEEDAKAAIAISVSEVTQTPEILELSKQIKEKLKEADLYDLEGKADMKIRALEMVEEFRTQRADKQSTLLLDAFNKDRASLPQPLPNPPPLAPLPVATPDARTQELINEKLKKAEELGEQGMLDEAQKALEEAEALKKLSIHLPPPRQEPPTDSAKYTAADVRVTDQKLRVCDICGAFLSVYDSDRRLADHFGGKLHLGYMQIREKLADLMEERSNKRKAPEEDRRSKERSRDLEREGSRDRDRASSRDRDRLRDSDRRSRDRGDRHNDRSRGYDRYDRDSRSRHRSRSRSRERVRDYDRPRRYDRY

SEQ ID NO: 12965 - protein, 411 aa, Eutrema parvulum
MDAMRKQLDVLMGANRNGDVTEVNRKYYDRDVCRLYLSGLCPHELFQLTKMDMGPCPKVHSLQLRKEYKEAKAKGVDNYDRELEDAIDRLIVECDRKIGRALKRLQEEDAKAAIAISVTEVTQSPEILELSKQIKEKMKEADLHDLEGKTDLKIRALELVEEMRTKRADLQAVLLLEAFNKDRASLPQPIPAQQPAAALPPPDPRTQEMINEKLKKAEEFGEQGMVDEAQKALEEAEALKKLTARQEPVVDSTKYTAADVRITDQKLRLCDICGAFLSVYDSDRRLADHFGGKLHLGYMLIRDKLAELQEEKNKVHKERVEERRSKERSRERESSRDRDRGDSRDRGRDLDRSGRDLDRRSRDRDRHHDHREHDRSYNQSRGYDSRSRRSSRSRSRERPRDYDRRRRHDRY

SEQ ID NO: 12966 - protein, 414 aa, Musa acuminata
MDAIRKQLDVLMGANRNGDVTEVNRKYYDRDVCRLFLAGLCPHDLFQLTKMDMGPCPKIHSLQLRKEYEEAKAKGDHNFDRELEDMIERLIVECERKIQRALKRLEDEDAKAAIAISVSKVTQTPEAIELSKQIKEKLKEADVFDFEGKTDSKIRVLEVVEELKAQRADKQSVLLLDAFNKDRASLPQPIQNPSPLATLPVLNPPDPHTQEMINEKLKKAEDLGEMGMIDEAQKALEEAEALKKLGARQEPVLESSKYSAADVRITDQKLRVCDICGAFLSVYDNDRRLADHFGGKLHLGYMQIREKLAELQEERNKKRKIDRSEDDRRSKERSRDHDRAGSRDRDIDREVRGDNRDRGREHDRRNRDHDRHYDRDHRDRDRDTDRSRNYDSRSRRRSRSRSRDRGRDYDRHRY

SEQ ID NO: 12967 - protein, 404 aa, Unknown
  Sequence found in Organisms: Brassica napus, Brassica rapa
MDAMRKQLDVLMGANRNGDVTEVNRKYYDRDVCRLYLSGLCPHELFQLTKMDMGPCPKVHSLQLRKEYKEAKAKGVDNYDRELEDAIDRLIVECDRKIGRALKRLQEEDAKAAIAISVTEVTQSPEILELSTQIKEKMKEADLHDLEGKTDMKIRALELVEEMRTKRADLQAVLLLEAFNKDRAALPQPIPGQPPAAALPPPDPRTQEMINEKLKKAEEFGEQGMVDEAQKALEEAEALKKLAPRQEPVVDSTKYTAADVRITDQKLRLCDICGAFLSVYDSDRRLADHFGGKLHLGYMLIRDKLAELQEEKNKVHKERVEERRSKERSRERESSRDRDRGGSRDRGRDIDRRSRDRDRHHDHREHDRNYNQSRGYDSRSRRSSRSRSRERTRDHDRRRRHDRY

SEQ ID NO: 12968 - protein, 395 aa, Populus trichocarpa
MDAMRKQLDVLMGANRNGDVREVNRKYYDRDVCRLYLVGLCPHELFQLTKMDMGPCPKVHSLQLRKDYEEARAKGVDSYDVELENVIDKLIVECDKKIGRALKRLEDEDAKAAIAISVTEVTQTPEVIELSKQIKEKLKEADKYDLEGTTDFKIQALEEVEKLRSERAEKQSAQLLEAFNKDRASLPQPMPNPPPSAPMPLPTPDPRTQEMINEKLKKAEDLGEQGMVDEAQKALEEAEALKKLPARQEPTTDQKLRVCDICGAFLSVYDSDRRLADHFGGKLHLGYMQIREKLTELQENKHRKGDRYDDRRSKERSRDRDRESSRDQDRGDSRDRGRDYDRRSRDHDRYNDRDRGYDREPERSHSYDSRSLRRSRSRSREHTRDYDRHRRYDRY

SEQ ID NO: 12969 - protein, 295 aa, Ambrosia trifida
SGSEFPDTLTTVCFLLRRRDGRNRKQLDVLMGANRNGDVTEVNRKYYDRDVCRLFLVGLCPHELFQLTKMDMGPCPKVHSFQLRKEYQEAKAKGQDNYDRELEDVIDRLIVECDRKIARALKRLSDEDAKAAIAISVSEVTQTPEILELSKQIKEKLKEADQYELEGKTDMKIRALEMVEELRTQRADKQSMLLLDAFNKDRASLPSPLPNPPSLAPLPVPVPDARTQELINEKLKKAEELGEQGMLDEAQKHLKRLKSLKSFQFTCLLVRNLLQTPLSILLQMCVVTDQEITFL

SEQ ID NO: 12970 - protein, 404 aa, Brassica napus
MDAMRKQLDVLMGANRNGDVTEVNRKYYDRDVCRLYLSGLCPHELFQLTKMDMGPCPKVHSLQLRKEYKEAKAKGVDNYDRELEDAIDRLIVECDRKIGRALKRLQEEDAKAAIAISVTEVTQSPEILELSTQIKEKMKEADLHDLEGKTDMKIRALELVEEMRTKRADLQAVLLLEAFNKDRAALPQPIPGQQPAAALPPPDPRTQEMINEKLKKAEEFGEQGMVDEAQKALEEAEALKKLTPRQEPVVDSTKYTAADVRITDQKLRLCDICGAFLSVYDSDRRLADHFGGKLHLGYMLIRDKLAELQEEKNKVHKERVEERRSKERSRERESSRDRDRGGSRDRGRDIDGRSRDRDRHHDHREHDRNYNQSRGYDSRSRRSSRSRSRERTRDYDRRRRHDRY

SEQ ID NO: 12971 - protein, 418 aa, Amorphophallus konjac
MDAIRKQLDALMGANRNGDVREVNRKYYDRDVCRLYLAGLCPHDLFQLTKMDLGPCPKVHSLTLRKEYEEAKAKGAHNFDRELEDLIEKLIVECERKIQRALKRLSDEDAKAAVAISVSDVTQSLEVLELSKQIKEKLKEVDALDLEGKSDDKIRVMEVVEELRTKRADKQSMLLLDAFNKDRASLPQPLQNPPPLAPVPAPAPPDPQTQELINEKLKTAEALGEQGLVDEAQKLLEEAEALRKSGARQEPVLDSSKYTAADVRITDQKLRLCDICGAFLSVYDNDRRLADHFGGKLHLGYMQIREKLTELQEERKKGRKVDERRSREREPDRAASRDRDRDRNDRGDNREQERDFDRRSRDHDRHYDRDRGYDREREREPDRSRGYDSRNRRRSRSRSRDRGRDSDRHRRHDRYDRH

SEQ ID NO: 12972 - protein, 399 aa, Eutrema halophilum
MDAMRKQLDVLMGANRNGDVTEVNRKYYDRDVCRLYLSGLCPHELFQLTKMDMGPCPKVHSLQLRKEYKEAKAKGVDNYDRELEDAIDRLIVECDRKIGRALKRLQEEDAKAAIAISVTEVTQSPEILELSKQIKEKMKEADLHDLEGKTDLKIRALELVEEMRTKRADLQAVLLLEAFNKDRASLPQPIPAQPPAAALPPPDPRTQEMINEKLKKAEEFGEQGMVDEAQKALEEAEALKKLTARQEPVVDSTKYTAADVRITDQKLRLCDICGAFLSVYDSDRRLADHFGGKLHLGYMLIRDKLAELQEEKNKVHKERVEERRSKERSRERESSKDRDRGDSRDRGRDLDRRSRDRDRHHDHREHDRNYNQSRGYDSRSRRSSRSRSRERPRDYDRRR

SEQ ID NO: 12973 - protein, 404 aa, Arabidopsis lyrata
MDAMRKQLDVLMGANRNGDVTEVNRKYYDRDVCRLHLSGLCPHELFQLTKMDMGPCPKVHSLQLRKEYKEAKAKGVDNYDRELEDAIDRLIVECDRKIGRALNRLQEEDAKAAIAISVTEFTQSPEILELSKQIKEKMKEADLHDLEGKTDLKIRALELVEEMRTKRADLQAVLLLDAFNKDRASLQQPVPAQQPAAALPPPDPRTQEMINEKLKKAEELGEQGMVDEAQKALEEAEALKKLTARQEPVVDSAKYTAVDVRITDQKLRLCDICGAFLSVYDSDRRLADHFGGKLHLGYMLIRDKLAELQEEKNKVHKERVEERRSKERSRERESSKDRDGGDSRDRGRDVDRRSRDRDRHHDHREHDRNYNQSRGYDSRSRRSSRSRSRERPRDYDRRRRHDRY

SEQ ID NO: 12974 - protein, 407 aa, Silene vulgaris
MDSLRKQLDVLMGANRNGDVREVNRKYFDRDVCRLFLSGLCPHELFQLTKMDMGPCPKVHSLQLRKEYEEAKAKGVDNYDRDLEDVIDRLIVECDRKITRALKRLADEDAKAAIAISVTEVTQTEEIDELSKQIKEKLHQVDQFDLEGKTDHKIRLLEEIDELRTKRADKQSMLLLDAFNKDRAALPQPLTNAPPLVPLPVVAPDARTQELINEKLKRAEDLGEQGMVDEAQKVMEEAEALKKLAPRPEPVGDSAKYTAADVRITDQKLRVCDICGAFLSVYDSDRRLADHFGGKLHLGYMQIREKLAELQEEKNKKRKLIEDDRRSRERSHDRERASSRDRDRGDRRSRDRDRHGDRDRGYDRGDRERSRSYDARSRRRSRSRSRERSRDYVRDYDRNRRYDRDRY

SEQ ID NO: 12975 - protein, 376 aa, Vigna unguiculata
MAAESSRRNPKRPFVEEDDELSKKPPAKKVRFPKGKKVKPGDEVVDKGNVEEGEVDLMNPQVAAKAAKERANQRNQFTAELFSEDTGGIGIDLSVGEVTYEDNENFVDDGIQIEPFNLDKEREEGYFDAAGNFVEYVRENEIKDAWLDNIEVDPKYSALKSVPTNDVDEGPADLSSKDIGIMKRRIANVLEPGETVLQALRRLKGSSDRKAKMSAETKVVFDQLTEDAMKLMENDVYHEKREVFDREAEGYEKLVRAKEGTSNQHLASGEASGNGEGDYDMFADEDEPDTSKPSTDENNAVSQSSSDAINSGIEGGALQNDYVFDESSGYYYSSSLGYYYDPNTGLYCSAASGQWYSFNEETGTYEEVDEAASNVN

SEQ ID NO: 12976 - protein, 138 aa, Vigna unguiculata
MDDLFDSSLNLEDTHYKEGYDEGHSDGLVAGKEEGRQVGLKVGFEIGEELGFYRGCVDIWNSALRLDPTCFSPRAKTIIGQMEELIEKYPLMDPENVQVQEIMDSLRLKFKMVCSSLHVKLEYSGYPKSSTEANDIQF

SEQ ID NO: 12977 - protein, 138 aa, Cajanus cajan
MDDLFDSSLNLEDTHYKEGYDEGYSHGLVAGKEEARQVGLKVGFEVGEELGFYRGCVDIWTSAIQLDPTCFSPRGKTIIGQMEELIQKYPLMDPENVRVQEIMDSLRLKFKMVCSSLHVKLEYNGYPKSSTEANDIQF

SEQ ID NO: 12978 - protein, 138 aa, Glycine max
MDDLFDSSLNLEDTHYKEGYDEGYSHGLVTGKEEARQVGLKVGFEVGEELGFYRGCVDIWTTAIQLDPTCFSPRATKIIGQLEELIQKYPLMDPENVQVQEIMDSLRLKFKMVCSSLHVKLEYNGYPKSSTEANDIQF

SEQ ID NO: 12979 - protein, 138 aa, Glycine max
MDDLFDSSLNLEDTHYKEGYDEGYSHGLVTGKEEARQVGLKVGFEVGEELGFYRGCVEIWTSAIRLDPTCFSPRAKTFICQMEELIQKYPLMDPENAQVQEIMDSLRLKFKMACSSLHVKLEYNGYPKSSTEVNDIQF

SEQ ID NO: 12980 - protein, 138 aa, Lupinus angustifolius
MDDIFDSSLNLEETHFKEGYDEGYTHGLISGKEDATQVGLKVGFEIGEELGFYRGCVDIWTSVIRVDPTQFSQRAKTGITQMEELLHKYPLMDPENSQVQEIMDSLRIKFKMVCYSLHVKLEYNGYPKSSAEANDIQF

SEQ ID NO: 12981 - protein, 138 aa, Lupinus angustifolius
MDDIFDSSLNLEETHFKEGYDEGYTHGLISGKEDATQVGLKVGFEIGEELGFYRGCVDIWNSVIRVDPTQFSQRAKTGITQMEELLHKYPLMEPENSQVQEIMDSLRIKFKIVSSSLHVKLDYNGYPKSSAEANDIQF

SEQ ID NO: 12982 - protein, 158 aa, Glycine max
MNKGAAGGLGGGAGAGSGPTAAAAAAAAQKRKTLVQRVEGDIANIVDNFSHLVNVARVNDPLVRNSQEAFMMEMRAARMVQAADSLLKLVSELKQTAIFSGFASLNDHVEQRRIEFNQLAEKTDHTLSRVGEEAAASLKELESHYSSSALKTMQNLQP

SEQ ID NO: 12983 - protein, 153 aa, Glycyrrhiza uralensis
MNKGGPGGGGGSGPTAAAAAAAAQKQKTLLQRVEGDIANIVDNFSHLVNVARVNDPPVRNSQEAFMMEMRAARMVQAADSLLKLVSELKQTAIFSGFASLNDHVEQRRVEFNQLAEKTDHTLSRVGEEAAASLKELESHYSSSAQKTIQNLQP

SEQ ID NO: 12984 - protein, 158 aa, Cajanus cajan
MNKGGAGGLGGGSGAGSGPTAAAAAAAAQKQKTLLHRVEGDIANIVDNFSHLVNVARVNDPPVRNSQEAFMMEMRGARMVQAADSLLKLVSELKQTAIFSGFASLNDHVEQRRNEFNQLAERTDRTLSNIGEEAAASLKELESHYSSSAQKTLQNLQP

SEQ ID NO: 12985 - protein, 156 aa, Lupinus angustifolius
MNKGGGALGGGGGSGPTAAAAAAAAQKQKTLLNRVEGDIANIVDNFSHLVNVARVNDPPVRNSQEAFMMEMRAARMVQAADSLLKLVSELKQTAIFSGFASLNDHVEQRRVEFNQLGEKTDRLLSRIGEEAAASLTEFESHYSSSAQKTIQNLQQP

SEQ ID NO: 12986 - protein, 156 aa, Glycine max
MNKGAAGGLGGGAGSGPTAAAAAAAAQKQKTLLQRVEGDIANIVDNFNHLVNVARVNDPPVRNSQEAFMMEMRAARMVQAADSLLKLVSELKQTAIFSGFASLNDHVEERRIEFNQLAEKTDRTLSRVGEEAAASLKGLESHYSSSVQKIIQNPQP

SEQ ID NO: 12987 - protein, 157 aa, Lupinus angustifolius
MNKGGGVLGGGGGGGSGPTAAAAAAAAQKQKTLLNRVEGDIANIVDNFSHLVNVARVNDPPVRNSQEAFMMETRAARMVQAADSLLKLVSELKQTAIFSGFASLNDHVEQRRDEFNQLGEKTDRLLSRIGEEAAASLTEFESHYSSSAQKTVQNMQP

SEQ ID NO: 12988 - protein, 150 aa, Medicago truncatula
MNKGGPGGGGPTAAAAAAAAQKQKTLLQRVEGDIANIVDNFSHLVNVARVNDPPVRNSQEAFMMEMRAARMVQAADSLLKLVSELKQTAIFSGFASLNDHVEQRRLEFNQLAEKTDHTLSTIGEEAAASLKELESHYSSSAQKTIQDVQP

SEQ ID NO: 12989 - protein, 151 aa, Trigonella foenum-graecum
MNKGGPGGGGPTAAAAAAAAQKQKTLLQRVESDIANIVDNFSHLVNVARVNDPPVRNSQEAFMMEMRAARMVQAADSLLKLVSELKQTAIFSGFASLNDHVEQRRVEFNQLAEKTDHTLSTIGEEAAASLKELESHYSSSAQKTIQNDNRS

SEQ ID NO: 12990 - protein, 151 aa, Pisum sativum
MNKGGPGGSGPTAAAAAAAAQKQKTLLQKVEGDIANIVDNFSHLVNVARVNDPPVRNSQEAFMMEMRAARMVQAADSLLKLVSDLKQTAIFSGFASLNDHVEQRKVEFNQLAEKTDHTLSRIGEEAAASLTELESHYSSSAQKTIQDIQQP

SEQ ID NO: 12991 - protein, 159 aa, Unknown
  Sequence found in Organisms: Prunus persica, Prunus mume
MNKGGGAASGGGLGGGGSGPTAAAAAAAAQKQKALLQRVETDIANIVDNFSSLVNVSRVNDPPVRNSQEAFMMEMRAARMVQAADSLLKLVSELKQTAIFSGFASLNDHVEQRIVEFNQQAEKTDQMLARIGEEAAASLKELESHYYSSALRTSENLQP

SEQ ID NO: 12992 - protein, 150 aa, Cicer arietinum
MNKGGPGGGGPTAAAAAAAAQKQKTLLQRVDGDIANIVDNFSHLVNVARVNDPPVRNSQEAFMMEMRAARMVQGADSLLKLVSELKQTAIFSGFASLNDHVEQRKVEFNQLAEKSDRTLSRIGEDAAASLKELESHYSSSAQKTNQNMDP

SEQ ID NO: 12993 - protein, 150 aa, Arachis hypogaea
MNKGGPVGGGGLGVGGSGPTAAAAAAAAQKQKTLLQRVEGDIANIVDNFSHLVNVARVNDPPVRNSQESFMMEMRAARMVQAADSLLKLVSELKQTAIFSGFASLNDHVEQRRVEFNELGEKTDRLLSRIGEEAAASLKELETHYSSSAQ

SEQ ID NO: 12994 - protein, 159 aa, Bruguiera gymnorhiza
MNRGGVGVGPGGALGAGSGPTAAATAAAAQKQKTLMQRVETDIANIVDNFTHLVNVARVNEPPVRNSQEAFMMEMRAARMVQAADSLLKLVSELKQTAIFSGFASLNDHVDQRITEFNHLAEKTDRMLARVGEEAAGSLKELESHYYSSAHRTNQNLPP

SEQ ID NO: 12995 - protein, 408 aa, Malus domestica
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDGAGFPAVVTAHFVPVDGQQRPRTTILIKFAEEVTDYLFVLHYVRSDVPILSSYSNLVVFFPLQVVLRNTMKKVETSRWIIKLVRFSPLRRAFRRRMNKGGGAASGGGGLGGAGSGPTAAAAVAAAQKQKALLHRVENDITNIVDNFSQLVNVSRVNDPPVRNSQEAFMMETRAARMVQAADSLLKLVSELKQTAIFSGFASLNDHVEKRIVEFNQQAENTDRLLARIGEEAAASLKELESHYYSSALRTAQNLQP

SEQ ID NO: 12996 - protein, 156 aa, Eucalyptus grandis
MNRGGGAGAGLGSGSGPTAAAAVAAAQKQKTLLQRVENDIGNIVDNFSHLVNVARVNDPPVRNSQEAFMMEMRAARMVQAADSLLKLVSELKQTAIFSGFASLNDHVEQRIVEFNQQAEKSDRTLSRIAEEAAASLKELESHYYSSLQRTTHPTES

SEQ ID NO: 12997 - protein, 156 aa, Eucalyptus grandis
MNRGGGAGAGLGSGSGPTAAAAAAAAQKQKTLLQRVENDIGNIVDNFSHLVNVARVNDPPVRNSQEAFMMEMRAARMVQAADSLLKLVSELKQTAIFSGFASLNDHVEQRIVEFNQQAEKSDRTLSRIVEEAAASLKELESHYYSSLQRTTHPTES

SEQ ID NO: 12998 - protein, 149 aa, Lotus japonicus
GVGGSGGGGGPTASAAAAAVQKQKTLLQRVEGDIASIVDNFSHLVNVARVNDPPVRNSQEAFMMEMRAARMVQAADSLLKLVSELKQTAIFSGFASLNDHVEQRKVEFNQLGEKTDSMLSRIGEEAAASLKELESHYSSSAQKTIQNQQ

SEQ ID NO: 12999 - protein, 166 aa, Fagus grandifolia
MNKGGAGGVGGGGSGTSGAGSGPTAAAAAAAAQKQKTLLQRVEGDIGNIVDNFSHLVNVSRVNDLPVRNSQEAFMMEMRAARMVQAADSLLKLVSELKQTAIFSGFASLNDHVEQRTAEFNQQAEKTDHMLARIGDEAAANSRSSSRIIYFSGEEIKPAAMIMNGA

SEQ ID NO: 13000 - protein, 149 aa, Arachis hypogaea
GPVGGGGLGVGGSGPTAAAAAAAAQKQKTLLQRVEGDIANIVDNFSHLVNVARVNDPPVRNSQESFMMEMRAARMVQAADSLLKLVSELKQTAIFSGFASLNDHVEQRRVEFNELGEKTDRLLSRIGEEAAASLKELETHYSSSAQKNI

SEQ ID NO: 13001 - protein, 156 aa, Eucalyptus grandis
MNRGGGAGAGLGSGSGPTAAAAAAAAQKQKTLLQRVENDIGNIVDNFSHLVNVARVNDPPVRNSQEAFMMEMRAARMVQAADSLLKLVSELKQTAIFSGFASLNDHVEQRIVEFNQQGEKSDRTLSRIAEEAAASLKELESHYYSSLQRTTHPTES

SEQ ID NO: 13002 - protein, 156 aa, Euonymus alatus
MSKGGSAGGGGMGGSGPTAAAAAAAAQKQKTLMQRVETDIANIVDNFSHLVNVSRVDDPPVRNSQEAFMMEMRAARMVQAADSLLKLVSELKQTAIFSGFASLNDHVKQRAKEFDHLAETTDSVLARIGDEAAASLRELESHYYSSAQRTAPNVQP

SEQ ID NO: 13003 - protein, 155 aa, Catharanthus roseus
MNKGGIGLGSGGGGGPTAAAAAAAAQKQKTLLQRVDADIGNIVDNFSFLVNVARVNDPPVRNSQEAFMMEMRAARMVQAADSLLKLVSELKQTAIFSGFASLNDHVEQRIEEFNQQAEKTESTVARIGEEAAASLKELESHYYSSAQRTESHDNQ

SEQ ID NO: 13004 - protein, 150 aa, Vitis vinifera
MNKGGGAGGGPTAAAAAAAAQKQKTLLQRVETDIANVVDHFTFLVNVARVNDPPVRNSQEAFMMEMRAARMVQAADSLLKLVSELKQTAIFSGFASLNDHVDQREAEFNQQAEKTDHLLARIGEEAAASLKELESHYYSSAQRTSEPPQP

SEQ ID NO: 13005 - protein, 251 aa, Vigna unguiculata
MALAPSKVSPFSGLSLTEAVGGTVKNPTCSVSLGFLNKKVKSRNLGVSASTAPLTGVIFEPFEEVKKEELAVPTAPQVSLARQYYADECESAINEQINVEYNASYVYHSLFAYFDRDNVALKGFAKFFKESSEEEREHAEKLMKYQNTRGGRVVLHPIKNVPSEFEHVEKGDALYAMELALSLEKLVNEKLRSVHSVAGSNNDPQLADFIESEFLSEQVESIKKISEYVAQLRRVGKGHGVWHFDQSLLHA

SEQ ID NO: 13006 - protein, 250 aa, Glycine max
MALAPSKVSTFSGFSPKPSVGGAQKNPTCSVSLSFLNEKLGSRNLRVCASTVPLTGVIFEPFEEVKKSELAVPTAPQVSLARQNYADECESAINEQINVEYNASYVYHSLFAYFDRDNVALKGFAKFFKESSEEEREHAEKLMKYQNTRGGRVVLHPIKNVPSEFEHVEKGDALYAMELALSLEKLVNEKLLNVHSVADRNNDPQMADFIESEFLSEQVESIKKISEYVAQLRRVGKGHGVWHFDQRLLD

SEQ ID NO: 13007 - protein, 250 aa, Glycine max
MALAPSKVSSFSGFSPKPSVGDALKNPTCSVSLSFANVKLGSRNLRVCASTVPLSGVIFEPFEEVKKGELAVPTAPQVSLARQNYADECESAINEQINVEYNASYAYHSLFAYFDRDNVALKGFAKFFKESSEEEREHAEKLMKYQNTRGGRVVLHAIKNVPSEFEHVEKGDALYAMELALSLEKLVNEKLLNVHSVADRNNDPQLADFIESEFLSEQVESIKKISEYVAQLRRVGKGHGVWHFDQRLLD

SEQ ID NO: 13008 - protein, 256 aa, Cajanus cajan
MALAPSKVSSFSGLSLTTSGGDVPKNPTCSSYLSFVNKKFGSRSLRVCSASTAPLTGVIFEPFEEVKKGELAIPTAPQVSLARQNYAGDCESAINEQINVEYNASYVYHSLFAYFDRDNIALKGLAKFFKESSEEEREHAEKLMKYQNTRGGRVVLHPIKNVPSEFEHEEKGDALYAMELALSLEKLVNEKLLNVHSVADLNNDPQMADFIESEFLSEQVEAIKKISEYVAQLRRVGKGHGVWHFDQRLLHEGNAA

SEQ ID NO: 13009 - protein, 259 aa, Cyamopsis tetragonoloba
MALATSKVSSFSGFSLSNIVGDCGRNPTSSSSSLSFAISSPPPSLSLGEKWGSSRVSASTVPLTGVIFEPFEEVKKDNLAVPTASQISLARQNYADECESVINEQINVEYNASYVYHSLFAYFDRDNVALKGFAKFFKESSEEEREHAEKLMKYQNIRGGRVVLHPIKNVPSEFDHEEKGDALHAMELALSLEKLVNEKLLNVHSVADRNNDPEMANFIEGEFLSEQVESIKKISEYVAQLRRVGKGHGVWHFDQRLLN

SEQ ID NO: 13010 - protein, 163 aa, Vigna unguiculata
MAAPIFNTPFFTLFVFFSLQLYLSFSSSPSIHDLLRSKGLPPGLLPEEVKSYTFSQNGHLEVFLDAPCLTKYENRVLFEQVVTANLTYGSLIGVEGLQQEELFVWLPVKDIIVNDPSSGLILFDIGLAHKQLSLSLFEDPPHCKPEGGLRNHVRKEKGLEVLR

SEQ ID NO: 13011 - protein, 160 aa, Cyamopsis tetragonoloba
TRFNTPSFITLFISLSLLFSLSLSSSSIHDLLRSKGLPPGLLPEEVKSYTFSENGRLEVFLDAPCLTKYENRVLFEQVVTANLTYGSLIGVEGLQQEELFVWLPVKDIIVNDPSSGLILFDIGLAHKQLSLSLFEDPPHCKPEGGLRNHVRKEKGFESLR

SEQ ID NO: 13012 - protein, 173 aa, Glycine max
MAARATAIFNTPSSSSFFTFTLFLSLSLLLQLSLSSPSPSIHDLLRSKGLPPGLLPEEVKSYSFSETGHLEVFLDAPCLTKYENRVLFEQVVTANLTYGSLIGVEGLQQEELFVWLPVKDIIVNDPSSGLILFDIGLAHKQLSLSLFEDPPHCKHEGGLRNHVRKEKGFEALR

SEQ ID NO: 13013 - protein, 154 aa, Cajanus cajan
MITLFLSLSLLLHLSLSSSSSIHDLLRSKGLPPGLLPEEVKSYTFSQNGHLEVFLEAPCLTKYENRVLFQQVVTANLTYGSLIGVQGLQQEELFVWLPVKDIIVNDPSSGLILFDIGLAYKQLSLSLFEDPPHCKPQGGLRNHVRKEKGFEALR

SEQ ID NO: 13014 - protein, 164 aa, Lupinus angustifolius
MAFLKLFTTLFSFSLLLLLSPSLSLSSPSSSIHDLLRSKGLPAGLLPEEVKSYTFSEDGCLKVFLDAPCMTKYETRVFFERVVTANLTYGSLIGVEGLQQEELFVWLPVKDIIVNDPSSGLILFDIGLAYKQLSLSLFEDPPHCKPQGGLRNHVRKEKGFEALR

SEQ ID NO: 13015 - protein, 422 aa, Vigna unguiculata
MMSVTGKTIDFAGKNLVSCGCSSNASFDRYTVRNYARVSSKGCGKGHGTCRLFCCTRRNTQCRVSSMKTAEPTVNGGTQAIEGLNKGLNLKGYSETPISAARFFEAVADDLLTLNKNLQSIVGAENPVLMSAAEQIFSAGGKRMRPALVFLVARATAELLGLKELTVKHRRLAEIIEMIHTASLIHDDVLDESDLRRGKKTIHQIFGTRVAVLAGDFMFAQSSWYLANLENIEVIKLISQVIKDFASGEIKQASSLFDCDVELEEYLIKSYYKTASLIAASTKGAAIFSGADSGITEKMYEYGRNLGLSFQIVDDILDFTQSAEQLGKPSGSDLAKGNLTAPVIFALEKEPKLRDIIESEFSEDGSLDEAINLVKSCGSIERAQELAKEKADLAIQSLQCLPQSVYRLALEDMVAYNLQRIA

SEQ ID NO: 13016 - protein, 423 aa, Glycine max
MMSVTGKGIDFAGKNLVSGCSSNASFDWYTVRNYAKANSNNSNGCGRGHGRKLVCCKRRSTQCRVSSMKTAQPTVNGGTHAIEGLTTGLDLKGYSEAPISPARFFEAVADDLLTLNKNLQSIVGAENPVLMSAAEQIFSAGGKRMRPALVFLVSRATAELLGLKELTVKHRRLAEIIEMIHTASLIHDDVLDESDLRRGKKTVHQMFGTRVAVLAGDFMFAQSSWYLANLENIEVIKLISQVIKDFASGEIKQASSLFDCDVQLDEYLIKSYYKTASLIAASTKGAAIFSGSDSSVTEKMYEYGKNLGLSFQVVDDILDFTQSAEQLGKPAGSDLAKGNLTAPVIFALEKEPKLRDIIESEFSEVGSLDEAINLVKSCGGIERAQELAKEKADLAIQSLQCLPQSVFRLALEDMVAYNLQRIA

SEQ ID NO: 13017 - protein, 425 aa, Cajanus cajan
MMCVTGKSIDFAGKNLVSCGCSSNASFDRYTVRSCVKVNSKGCGGSGRGHGARKLVCCRRRNTQCRVSSMKTAEPTLNGGTKAIEGLTTGLDLKGYSESPISPARLFEVVADDLLTLNKNLQSIVGAENPVLMSAAEQIFSAGGKRMRPALVFLVSRATAELLGLKELTVKHRRLAEIIEMIHTASLIHDDVLDESDLRRGKKTVHQMFGTRVAVLAGDFMFAQSSWYLANLENIEVIKLISQVIKDFASGEIRQASSLFDCDLHLDEYLIKSYYKTASLIAASTKGAAIFSGADSSITEKMYEYGKNLGLSFQVVDDILDFTQSAEQLGKPAGSDLAKGNLTAPVIFALEKEPKLRDIIESEFSEVGALDEAINLVKGCGGIERAQELAKEKADLAIQCLQCLPQSVFRLALEDMVAYNLQRIA

SEQ ID NO: 13018 - protein, 426 aa, Glycine max
MMSVTGKSIDFAGKNLVSCGCSSNASSFDRYTVRNYAKLNSNNSKGCGRDHGARKLVCCKKRSTHCRVSSMKTAQPTVNGGTHAFEGLTTGLDLKGYSEDPISPARLFEVVADDLLTLNKNLQSIVGAENPVLMSAAEQIFSAGGKRMRPALVFLVSRATAELLGLKELTAKHRRLAEIIEMIHTASLIHDDVLDESDLRRGKKTVHQMFGTRVAVLAGDFMFAQSSWYLANLENIQVIKLISQVIKDFASGEIKQASSLFDCDVQLDEYLIKSYYKTASLIAASTKGAAIFSGADSSVTEKMYEYGRNLGLSFQVVDDILDFTQSAEQLGKPAGSDLAKGNLTAPVIFALEKEPKLRDIIESEFSEVGSLEEAINLVKSCGGIERAQELAKEKADLAIQSLQCLPQSVFRLALEDMVAYNLQRIA

SEQ ID NO: 13019 - protein, 419 aa, Lotus japonicus
MMTVTSSSIDFAGKNLVYCGCSSNASFDRYTVRNYQKLNSKGCGARKSICCKRKSTQCKVSSMKTAEPALNGGTQAIKGLTGRLDLKSSSSETPISPARLFEVIADDLLTLNKNLQSIVGAENPVLMSAAEQIFSAGGKRMRPALVFLVSRATAELLGLKELTLKHRRLAEIIEMIHTASLIHDDVLDESDLRRGKETVHQLFGTRVAVLAGDFMFAQSSWYLANLENIEVIKLISQVIKDFASGEIKQASSLFDCDVQLEEYLIKSYYKTASLIAASTKGAAIFSGADHSITEKMYEYGKNLGLSFQVVDDILDFTQSAEQLGKPAGTDLAKGNLTAPVIFALEKEPKLRDIIESEFSETGSLDEAITLVKSCGGIERAQELAKEKADLAIQSLQCLPQSVFRLALEDMVTYNLQRIA

SEQ ID NO: 13020 - protein, 421 aa, Trigonella foenum-graecum
MMSVTSKSIDFFGKNLVSCGCSSNASFHRYEVKNYAKVNSKGCRNGARKLVCCKKRNTPQYRVSSMETAEPTLNGGTQAIKDLAKGLNLKSYPETPISPNRLFEVVSDDLLTLNKNLQSIVGAENPVLISAAEQIFSAGGKRMRPALVFLVSRATAELHGLEDLTVKHRRLAEIVEMIHTASLIHDDVLDESDLRRGKETVHQMFGTRVAVLAGDFMFAQSSWYLANLENIEVIKLISQVIKDFASGEIKQASSLFDCDVQLDEYLIKSYFKTASLIAASVKGAAVFSGSDSSLTEKMFEYGKNLGLSFQVVDDILDFTQSAEQLGKPAGTDLAKGNLTAPVIFALEKEPKLRDIIESEFSEIGSLDEAIKLVKSCGGIERAQELAKEKADLAIQSLQCLPQSVYRLALEDMVTYNLQRIA

SEQ ID NO: 13021 - protein, 421 aa, Cicer arietinum
MMSFTSKSIEFFGKNLVSCGCSSNASFDRNKVRNYGKVNSKGCGNGARKLICCKKKNTTQYRVSSMETAEPTLNGGAQAIKDLAKGLNLKSYSETPISPNRLFEVVSDDLQTLNKNLQSIVGAENPVLISAAEQIFSAGGKRMRPALVFLVSRATAELLGLEDITVKHRRLAEIIEMIHTASLIHDDVLDESDLRRGKETVHQMFGTRVAVLAGDFMFAQSSWYLANLENIEVIKLISQVIKDFASGEIKQASSLFDCDVQLDEYLIKSYYKTASLIAASTKGAAVFSGSDSNITEKMYEYGKNLGLSFQVVDDILDFTQSAEQLGKPAGTDLAKGNLTAPVIFALEKEPKLRDIIESEFSEIGSLDEAIALVKSCGGIERAQELAKEKADLAIQSIQCLPQSVYRLALEDMVTYNLQRIA

SEQ ID NO: 13022 - protein, 421 aa, Medicago truncatula
MMSVTSKSIDFFGKNLVYCGCSSNASFHRYEVKNYAKVNSKGCGNGARKLVCCKKRNTHQYRVSSMDTAEPTLNGGTQAIKDLAKGLNLKSYPATPISPNRLFEVVSDDLLTLNKNLQSIVGAENPVLISAAEQIFSAGGKRMRPALVFLVSRATAELHGLEDLTVKHRRLAEIVEMIHTASLIHDDVLDESDLRRGKETVHQMFGTRVAVLAGDFMFAQSSWYLANLENIEVIKLISQVIKDFASGEIKQASSLFDCDVQLDEYLIKSYFKTASLIAASVKGAAVFSGSDSSMTEKMFEYGKNLGLSFQVVDDILDFTQSAEQLGKPAGTDLAKGNLTAPVIFALEKEPKLRDIIESEFSEIGSLDEAIKLVKSCGGIERAQELAKEKADLAIQSLQCLPPSVYRLALEDMVTYNLQRIA

SEQ ID NO: 13023 - protein, 421 aa, Arachis hypogaea
MISVTSKSIDYAGKNLVSCGCSSNANTVRSYAARVNSKVWGRRGGHGAANFVCCKSRSIQCRVSSMKTAEPTVNGGTDAIQGIPTGLDLKSYSETPISPSKLFEVVADDLQTLNKNLQSIVGAENPVLMSAAEQIFSAGGKRMRPALVFLVSRATAELLGLKDLTVKHRRLAEIIEMIHTASLIHDDVLDESDLRRGKETVHQMFGTRVAVLAGDFMFAQSSWYLANLENIEVIKLISQVIKDFASGEIKQASSLFDCDVELDEYLIKSYYKTASLIAASTKGAAIFSGADRNITEKMFEYGKNLGLSFQVVDDILDFTQSAEQLGKPAGTDLAKGNLTAPVIFALEKEPKLRDIIESEFSETSSLDEAIKLVKSCGGIERAQELAKEKADLAIQSLQCLPPSIFRLALEDMVAYNLQRIA

SEQ ID NO: 13024 - protein, 423 aa, Lupinus angustifolius
MMSVTSKSIDFVGKNLVYGGCFSNASFDRYTVRNYAKVNSKGFLGRGHGASNSICCKKRSTQCRVSSIMNIVESTLNGGTQAIQGLTGLDLKNYSETPISSTQLFDVVADDLQMLNKNLQSIVGAENPVLMSAAEQIFSAGGKRMRPALVFLVSRATAELLGLTELTAKHRRLAEIIEMIHTASLIHDDVLDESDLRRGKETVHQLFGTRVAVLAGDFMFAQSSWYLANLENIEVIKLISQVIKDFASGEIKQASSLFDCDVKLDEYLIKSYYKTASLMAASTKGAAIFSGADNIISEKMYEYGKNLGLSFQVVDDILDFTQSAEQLGKPAATDLSKGNLTAPVIFALEKEPKLRDIIESEFSETGSLAEAIELVKGCGGIERAQELAKEKADLAIQSLQCLPQSVFRLALEDMVAYNLQRIA

SEQ ID NO: 13025 - protein, 233 aa, Medicago truncatula
MMSVTSKSIDFFGKNLVYCGCSSNASFHRYEVKNYAKVNSKGCGNGARKLVCCKKRNTHQYRVSSMDTAEPTLNGGTQAIKDLAKGLNLKSYPATPISPNRLFEVVSDDLLTLNKNLQSIVGAENPVLISAAEQIFSAGGKRMRPALVFLVSRATAELHGLEDLTVKHRRLAEIVEMIHTASLIHDDVLDESDLRRGEETVHQMFGQEWQCWLETSCLHSHHGISPTLKTLSH

SEQ ID NO: 13026 - protein, 414 aa, Lupinus angustifolius
MMSLTSKSIDFVGKNLIFGGSCSNASFDSYIVRNYAKVNGGSRMVWCKRRSTQCGVSSIMKIVEPTLNGGTQAIQGLNGLDLKNYSDAPISPAQLFDVVADDLKTLNKNLQSIVGAENPVLMSAAEQIFSAGGKRMRPALVFLVSRATAELLGLNELTVKHRRLAEIIEMIHTASLIHDDVLDESDLRRGKKTVHQLFGTRVAVLAGDFMFAQSSWYLANLENIEVIKLISQVIKDFASGEIKQASSLFDCDVQLDEYLVKSYYKTASLIAASTKGAAIFSGADNIITEKMYEYGKNLGLSFQVVDDILDFTQSAEQLGKPAATDLSKGNLTAPVIFALEKEPKLRDIIESEFSEPGSLDEAIELVKSCGGIERAQELAKEKADLALQNLQCLPQSAFRLALEDMVAYNLQRIA

SEQ ID NO: 13027 - protein, 117 aa, Vigna unguiculata
MASEETQNKATTEQSSSELLASAKLVADAAQSTLRNESDKVDKAKVAGAAGDLLDAAGKYGKLDEQKGVGQYVDKAADYLHGYKDKAAAPSQSEDSKPQEGGGLAGGIANLAGGFFK

SEQ ID NO: 13028 - protein, 355 aa, Vigna unguiculata
MAAMATTTLTSNPKLSFFDHKPTSFHGKPVSQYRLTPTKCSAKPPAISMSLTTPPYDFQSFKFQPIKESIVAREMTRRYMTDMITYADTDVVVVGAGSAGLSCAYELSKNPAVQIAIIEQSVSPGGGAWLGGQLFSAMVVRKPAHLFLDELGVAYDEQEDYVVIKHAALFTSTIMSKLLARPNVKLFNAVAAEDLIVKEGRVAGVVTNWALVSMNHDTQSCMDPNVMEAKVVVSSCGHDGPFGATGVKRLKSIGMIDNVPGMKALDMNTAEDAIVRLTREIVPGMIVTGMEVAEIDGAPRMGPTFGAMMISGQKAAHLALKALGRNNAIDGTCGVGREEPELMFASANTEDIVDA

SEQ ID NO: 13029 - protein, 351 aa, Glycine max
MAAMATTTLSSNPKLSFFNGKPVTYSSRVAPTTKLSSSKQGTISMSLTPPPYDLQSFKFQPIKESIVSREMTRRYMTDMITYADTDVVIVGAGSAGLSCAYELSKNPAVSVAIVEQSVSPGGGAWLGGQLFSAMVVRKPAHLFLDELGVAYDEQEDYVVIKHAALFTSTIMSRLLARPNVKLFNAVAAEDLIVKEGRVAGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGRNNAIDGTCGVGREEPQLILASADTEEIVDA

SEQ ID NO: 13030 - protein, 351 aa, Glycine max
MAAMATTTLSSNPKLSFFHGKPVTYSSRVAPTTKLFSSKQGTISMSLTQPPYDLQSFKFQPIKESIVSREMTRRYMTDMITYADTDVVIVGAGSAGLSCAYEISKNPAVSVAIIEQSVSPGGGAWLGGQLFSAMVVRKPAHLFLDELGVAYDEQEDYVVIKHAALFTSTIMSRLLARPNVKLFNAVAAEDLIVKEGRVAGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGRNNAIDGTCGVGREEPQLIFASADTEEIVDA

SEQ ID NO: 13031 - protein, 346 aa, Cajanus cajan
MAAMATTTLKLSFFQGRPMTPRVAATKPMASTFPQATISMSLTQPSYDLQSFNFQPIKESIVSREMTRRYMTDMITYADTDVVIVGAGSAGLSCAYELSKNPAVRVAIIEQSVSPGGGAWLGGQLFSAMVVRKPAHLFLDELGVAYDEQEDYVVIKHAALFTSTIMSRVLARPNVKLFNAVAAEDLIVKEGRVAGVVTNWALVSLNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGRNNAIDGTCGAAREEPELIFASADTEEIVDA

SEQ ID NO: 13032 - protein, 351 aa, Arachis hypogaea
MAAMATTTALSSNLIKASAFHGTPVATSRVTPIKSQQQQSQTISMSMATPPYDLQSFKFQPIKESIVAREMTRRYMTDMITYADTDVIVVGAGSAGLSCAYELSKNPSIRVAIIEQSVSPGGGAWLGGQLFSAMVVRKPAHRFLDELEVAYDEQEDYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGKSNAIDGTCGLEIEEPQFVLASADTEDIVDA

SEQ ID NO: 13033 - protein, 355 aa, Unknown
  Sequence found in Organisms: Gossypium hirsutum, Gossypium raimondii
MAAMATTLTSLSSTPKPSFLDHKSSFHGTPLASRFTPIKSSSQTATISMSLTPPYDLQSFKFQPIKESYVAREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTVMSKLLARPNVKLFNAVAAEDLIVKENRVAGVVTNWALVSMNHDTQSCMDPNVMESKVVVSSCGHDGPFGATGVKRLKSIGMIDSVPGMKALDMNTAEDAIVRLTREVVPGMIVTGMEVAEIDGAPRMGPTFGAMMISGQKAAHLALKALGQPNAIDGTFSEAERVQPEFVLASAETEEIVDA

SEQ ID NO: 13034 - protein, 355 aa, Gossypium raimondii
MAAMATTLTSLSSTPKPSFLDHKSSFHGTPLASRFTPIKSSSQTSTISMSLTPPYDLQSFKFQPIQESYVAREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKENRVAGVVTNWALVSMNHDTQSCMDPNVMESKVVVSSCGHDGPFGATGVKRLKSIGMIDSVPGMKALDMNTAEDAIVRLTREVVPGMIVTGMEVAEIDGAPRMGPTFGAMMISGQKAAHLALKALGQPNAIDGTFSEAERVQPEFVLASAETEEIVDA

SEQ ID NO: 13035 - protein, 355 aa, Gossypium hirsutum
MAAMATTLTSLSSTPKPSFLDHKSSFHGTPLASRFTPIKSSSQTATISMSLTPPYDLQSFKFQPIKESYVAREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTVMSKLLARPNVKLFNAVAAEDLIVKENRVAGVVTNWALVSMNHDTQSCMDPNVMESKVVVSSCGHDGPFGATGVKRLKSIGMIDSVPGMKALDMNTAEDAIVRLTREVVPGMIVTGMEVAEIDGAPRMGPTFGAMMISGQKAAHLALKALGQPNAIDGTFSEAERVQPEFVLAAAETEEIVDA

SEQ ID NO: 13036 - protein, 355 aa, Gossypium hirsutum
MVAMATTLSSLSSTPKPSFLDHKSSFHGTPLASRFTPIKSSSQISTISMSLTPPYDLQSFKFQPIQESYVAREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKENRVAGVVTNWALVSMNHDTQSCMDPNVMESKVVVSSCGHDGPFGATGVKRLKSIGMIDSVPGMKALDMNTAEDAIVRLTREVVPGMIVTGMEVAEIDGAPRMGPTFGAMMISGQKAAHLALKALGQPNAIDGTFSEAERVQPEFVLAAAETEEIVDA

SEQ ID NO: 13037 - protein, 355 aa, Lotus japonicus
MAAMATTTLTSSLISNPKSSFSSFHGKPISTRTTSIKSTTQQNTTTISMSLNSPAYDLEAFKFAPIKESIVSREMTRRYMTDMITYADTDVVIVGAGSAGLSCAYELSKDPSISIAIIEQSVSPGGGAWLGGQLFSAMVVRKPAHLFLNEIGVDYDEQEDYVVIKHAALFTSTIMSKLLAKPNVKLFNAVAAEDLIVKEGRVAGVVTNWALVSMNHDTQSCMDPNVMEAKIVVSSCGHDGPFGATGVKRLKSIGMIDSVPGMKALDMNTAEDAIVRFTREVVPGMIVTGMEVAEIDGAPRMGPTFGAMMISGQKAAHLALKALGKNNAIDGTCEAVREEPELVLASVDAEETVDA

SEQ ID NO: 13038 - protein, 350 aa, Cicer arietinum
MATSSITTSLSSTPKSSFFNGRSIATRTSHLIKSTSHNYSSVSMSLNTPPYDLQSFKFQPIKESIVSREMTRRYMTDMITYADTDVVIVGAGSAGLSCAYELSKNPNINIAIIEQSVSPGGGAWLGGQLFSAMVVRKPAHLFLDEIGVDYDEQEDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDFVPGMKALDMNTAEDAIVRLTREVVPGMIVTGMEVAEIDGAPRMGPTFGAMMISGQKAAHLALKALGRNNAIDGTCDSAREEPELVLASVELEDTVDA

SEQ ID NO: 13039 - protein, 350 aa, Cicer arietinum
MATSSITTSLSSTPKSSFFNGRSIATRTSHIIKSTSHNYSSVSMSLNTPPYDLQSFKFQPIKESIVSREMTRRYMTDMITYADTDVVIVGAGSAGLSCAYELSKNPNINIAIIEQSVSPGGGAWLGGQLFSAMVVRKPAHLFLDEIGVDYDEQEDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDFVPGMKALDMNTAEDAIVRLTREVVPGMIVTGMEVAEIDGAPRMGPTFGAMMISGQKAAHLALKALGRNNAIDGTCDSAREEPELVLASVELEDTVDA

SEQ ID NO: 13040 - protein, 356 aa, Gossypium hirsutum
MAAMATALTSLSSSPKPSFLDHNKSSFSGTPIPSRFTPIKSSSHNSNISMSLTPPYDLQSFEFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNHDTQSCMDPNVMESKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAVDGTFSEAERVQPEFVLAAAETEETVDA

SEQ ID NO: 13041 - protein, 356 aa, Quercus alba
MAAMATTFTSSLPKPSFLDNNKSCFHGTPITTSRFTPIKSTPQNSTISMSLTPPYDLKSFTFQPIKESTVSREMTRRYMTDMITYADTDVVIVGAGSAGLSCAYELSKNPSIRIAIIEQSVSPGGGAWLGGQLFSAMVVRKPAHHFLDELEIEYDEQENYVVIKHAALFTSTIMSKLLARPNVKLFNAVAAEDLIVKEERVSGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTYSEAGGVQPELILAAAETGEIVVDA

SEQ ID NO: 13042 - protein, 356 aa, Unknown
  Sequence found in Organisms: Gossypium hirsutum, Gossypium raimondii
MAAMATALTSLSSSPKPSFLDHNKSSFSGTQIPSRFTPIKSSSHNSAISMSLTPPYDLQSFEFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNHDTQSCMDPNVMESKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAVDGTFSEAERVQPEFVLAAAETEETVDA

SEQ ID NO: 13043 - protein, 356 aa, Theobroma cacao
MAAITATLPSLSSSPKPSFLDHKSSFHGTPIASRFTPIRSSSQDSAISMSLNTPPYDLQSFNFQPIKESYVAREMTRRYMMDMITYADTDVIIVGAGSAGLSCAYEISKNPSIRVAIIEQSVSPGGGAWLGGQLFSAMVVRKPAHIFLDELGIQYDEQENYVVIKHAALFTSTIMSKLLARPNVKLFNAVAAEDLIVKDNRVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTFIEGGRVQPEFVLAAAETEGTVDA

SEQ ID NO: 13044 - protein, 356 aa, Theobroma cacao
MAAITTTLTSLSSSPKPSFLDHKSSFHGTPIASRFTPIRSSSQDSAISMSLNTPPYDLQSFNFQPIKESYVAREMTRRYMMDMITYADTDVIIVGAGSAGLSCAYEISKNPNIRVAIIEQSVSPGGGAWLGGQLFSAMVVRKPAHIFLDELGIQYDEQENYVVIKHAALFTSTIMSKLLARPNVKLFNAVAAEDLIVKDNRVAGVVTNWALVSMNHDTQSCMDPNVMESKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTFIEGGRVQPEFVLAAAETEGTVDA

SEQ ID NO: 13045 - protein, 356 aa, Castanea mollissima
MAAMATTFTSSLPKPSFLDNNKSCFHGTPVTTSRFTPIKSTPQNSTISMSLTPPYDLKSFTFQPIKESTVSREMTRRYMTDMITYADTDVVIVGAGSAGLSCAYELSKNPSIRIAIIEQSVSPGGGAWLGGQLFSAMVVRKPAHHFLDELEIEYEEQENYVVIKHAALFTSTIMSKLLARPNVKLFNAVAAEDLIVKEERVSGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGKYSEAGGIQPELILAAAETGEIVVDA

SEQ ID NO: 13046 - protein, 355 aa, Vitis vinifera
MASMATTLTSLSSNPKPAFFDNKSSFHGSPISYRVLPIKVSHQSPTISMSSVSPYDLQSFKFEPIKESIVAREMTRRYMMDMITYADTDVVIVGAGSAGLSCAYELSKNPSIRVAIIEQSVSPGGGAWLGGQLFSAMVVRKPAHHFLDELGIEYDEQDNYVVIKHAALFTSTIMSKLLARPNVKLFNAVAAEDLIVKEERVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALRALGQPNAIDGNYTEAETMQPELILAAAETGEIVDA

SEQ ID NO: 13047 - protein, 355 aa, Vitis vinifera
MASMATTLTSLSSNPKPAFFDNKSSFHGSPISYRVLPIKVSHQSPTISMSSASPYDLQSFKFEPIKESIVAREMTRRYMMDMITYADTDVVIVGAGSAGLSCAYELSKNPSIRVAIIEQSVSPGGGAWLGGQLFSAMVVRKPAHHFLDELGIEYDEQDNYVVIKHAALFTSTIMSKLLARPNVKLFNAVAAEDLIVKEERVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALRALGQPNAIDGNYTEAETMQPELILAAAETGEIVDA

SEQ ID NO: 13048 - protein, 349 aa, Trigonella foenum-graecum
MASMATASLTTSLSSTPKSSFFNGRPIATRTPTTIKSTPQKITMSLTTPPYDINSFKFAPIKESIVSREMTRRYMTDMITYADTDVVIVGAGSAGLSCAYELSKNPNISIAIIEQSVSPGGGAWLGGQLFSAMVVRKPAHLFLDEIGVEYDEQEDYVVIKHAALFTSTIMSKLLAKPNVKLFNAVAAEDLIVKENRVAGVVTNWALVSMNHDTQSCMDPNVMEAKVVVSSCGHDGPFGATGVKRLKSIGMIDFVPGMKALDMNTAEDAIVRLTREVVPGMIVTGMEVAEIDGAPRMGPTFGAMMISGQKAAHLALKALGRNNAIDGTCESASEPELILASAESQDTVDA

SEQ ID NO: 13049 - protein, 356 aa, Gossypium hirsutum
MAAMATALTSLSSSPKPTFLDHNKSSFSGTPIPSRFTPIKSSSHNSAISMSLTPPYDLQSFKFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNHDTQSCMDPNVMESKVVVSSCGHDGPFGATGVKRLKSIGMIDSVPGMKALDMNPAEDAIVRLTREIVPGMIVTGMEVAEIDGAPRMGPTFGAMMISGQKAAPLPLKALGQPNPVDGTFSEAERVQPEFVLAAAETEETVDA

SEQ ID NO: 13050 - protein, 355 aa, Lupinus angustifolius
MAAMATSTLTSSFVSSNPKSSSFQFNGNPFSSRMKSIPQQHTSNTMISMSLTTPPYDLNSFKFQPIKESIVSREMTRRYMTDMITYADTDVVVVGAGSAGLSCAYELSKNPNISIAIIEQSVSPGGGAWLGGQLFSAMVVRKPAHRFLDELEIEYDEQEDYVVIKHAALFTSTIMSKLLARPNVKLFNAVAVEDLIVKGGRVGGVVTNWALVSMNHDTQSCMDPNVMEAKVVVSSCGHDGPFGATGVKRLRSIGMIESVPGMKALDMNAAEDAIVNLTREIVPGMIVTGMEVAEIDGSPRMGPTFGAMMISGQKAAHLALKALGKNNAIDGTCELGIETPNLVLASAETKEIVDA

SEQ ID NO: 13051 - protein, 356 aa, Gossypium hirsutum
MAAMATALTSLSSSPKPSFLDHNKSSFSGTQIPSRFTPIKSSSHNSAISMSLTPPYDLQSFEFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNPDTQSCMDPNVMESKVVVSSCGHDGPFGATGVKRLKSIGMIDSVPGMKALDMNPAEDAIVRLTREIVPGMIVTGMEVAEIDGAPRMGPTFGAMMISGQKAAPLALKALGQPNPVDGTFREAERVQPEFVLAAAETEETVDA

SEQ ID NO: 13052 - protein, 359 aa, Citrus sinensis
MAAMSTTLTSSLSSGPKSSFLDHKSSFHGSPIITSRVTPIRSSSQSQTHTISMSLTPQYDFNSFTFDPIKESIVSREMTRRYMTDMVTYADTDVIVVGAGSAGLSCAYEISKNPSIRVAIIEQSVSPGGGAWLGGQLFSAMVVRKPAQRFLDELGVEYDEQDNYVVIKHAALFTSTIMSKLLARPNVKLFNAVAAEDLIVKGGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTFSEVTEVQPEFVLAATENSEIVDA

SEQ ID NO: 13053 - protein, 350 aa, Populus trichocarpa
MATTLTPYLSANLKSSFLDNKSSFHGTPITTTTRFTPIKSTSPAISMSLTQPSYDLQSFKFQPIKESIVSREMTRRYMTDMVTYADTDVVIVGAGSAGLSCAYELSKNPSVRVAIIEQSVSPGGGAWLGGQLFSAMIVRKPAHRFLDELEIEYDEADNYVVIKHAALFTSTIMSKLLARPNVKLFNAVAAEDLIVKGGRVSGVVTNWALVSMNHNTQSCMDPNVMEAKVVVSSCGHDGPFGATGVKRLKSIGMIDSVPGMKALDMNAAEDAIVRLTREIVPGMIVTGMEVAEIDGAPRMGPTFGAMMISGQKAAHLALKALGQPNALDGTFSLQPELVLAAAEAGDTVDA

SEQ ID NO: 13054 - protein, 349 aa, Medicago truncatula
MASMATASLATSLSSTPKSSFFNGRPIATRTSTIIKSTPQKITMSLTTPPYDINTFKFAPIKESIVSREMTRRYMTDMITYADTDVVIVGAGSAGLSCAYELSKNPNISIAIIEQSVSPGGGAWLGGQLFSAMVVRKPAHLFLDEIGVEYDEQEDYVVIKHAALFTSTIMSKLLAKPNVKLFNAVAAEDLIVKENRVAGVVTNWALVSMNHDTQSCMDPNVMEAKVVVSSCGHDGPFGATGVKRLKSIGMIDHVPGMKALDMNTAEDAIVRLTREVVPGMIVTGMEVAEIDGAPRMGPTFGAMMISGQKAAHLALKALGRNNAIDGTCESASEPELILASAESQDTVDA

SEQ ID NO: 13055 - protein, 359 aa, Citrus clementina
MAAMSTTLTSSLSSSPKSSFLDHKSSFHGSPIITSRVTPIRSSSQSQTHTISMSLTPQYDFNSFTFDPIKESIVSREMTRRYMTDMVTYADTDVIVVGAGSAGLSCAYEISKNPSIRVAIIEQSVSPGGGAWLGGQLFSAMVVRKPAQIFLDELGVEYDEQDNYVVIKHAALFTSTIMSKLLARPNVKLFNAVAAEDLIVKGGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTFSEVTEVQPEFILAATENSEIVDA

SEQ ID NO: 13056 - protein, 356 aa, Gossypium hirsutum
MAAMATALTSLSSSPKPSFLDHNKSSFSGTQIPSRFTPIKSSSHNSAISMSLTPPYDLQSFEFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNHDTQSCMDPNVMEFKVVVSSCGHDGPFGATGVKRLKSIGMIDSVPGMKALDMNPAEDAIVRLPREIVPGMIVTGMEVAEIDGAPRMGPTFGAMMISGQKAAPLPLKALGQPNPVDGPFSEAERVHPEFVLAAAETEETVDA

SEQ ID NO: 13057 - protein, 304 aa, Tabernaemontana elegans
MAAMATTLTSSPKPTFLENKSSFHGTPVLSRVQPVKSSSQNFSITMSATTPQYNLDSFSFQPIKESIVSREMTRRYMMDMITYADTDVVIVGAGSAGLSCAYELSKNPNIRVAIIEQSVSPGGGAWLGGQLFSAMVVRKPAHKFLDELEIEYDEQDNYVVIKHAALFTSTIMSKLLARPNVKLFNAVAVEDLIVKGDRVAGVVTNWALVSMNHDTQSCMDPNIMEAKVVVSSCGHDGPFGATGVKRLKSIGMIDSVPGMKALDMNAAEDAIVRLTREIVPGMIVTGMEVAEIDGAQEWGQLLGP

SEQ ID NO: 13058 - protein, 350 aa, Populus trichocarpa
MASTLTSSLSINLKSSFLDHKSSFHGTPITTTGRFTPIKSTSSAITMSLAQPSYDLQSFKFQPIKESIVSREMTRRYMTDMVTYADTDVVIVGAGSAGLSCAYELSKNPSVRVAIIEQSVSPGGGAWLGGQLFSAMIVRKPAHRFLDELEIEYDEADNYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGAPRMGPTFGAMMISGQKAAHLALKALGQPNALDGTFSLQPELVLAASEAGEIVDA

SEQ ID NO: 13059 - protein, 355 aa, Liriodendron tulipifera
MATTLTSSLSSKPKTPFLETTSFHGLPIPSRIQSVRSSPQHHQNVSITMSTSSPSYDLKSFQFQPIKESIVSREMTRRYMTDMITYADTDVVIVGAGSAGLSCAYELSKNPSVSVAIIEQSVSPGGGAWLGGQLFSAMVVRKPAHIFLDELGVDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDAVPGMKALDMNTAEDAIVRLTREIVPGMIVTGMEVAEIDGAPRMGPTFGAMMISGQKAAHLALKALGQPNALDGTSTLGSPLPEFVLASAEASEIADA

SEQ ID NO: 13060 - protein, 354 aa, Amsonia hubrichtii
MAAMATTLTFSPKPTFLENKSSFHGSPILSRSAQPIKSSSQNFGITMSATTPQYNLDSFKFQPIKESIVSREMTRRYMTDMITYADTDVVIVGAGSAGLSCAYELSKNPNVRIAIIEQSVSPGGGAWLGGQLFSAMVVRKPAHKFLDELEIEYDEQDDYVVIKHAALFTSTIMSKLLARPNVKLFNAVAVEDLIVRENRVAGVVTNWALVSMNHDTQSCMDPNVMEAKVVVSSCGHDGPFGATGVKRLRSIGMIDSVPGMKALDMNAAEDAIVRLTREIVPGMIVTGMEVAEIDGSPRMGPTFGAMMISGQKAAHLALRALGQPNALDGTQREEGIAHPELILAAAETDEIVDA

SEQ ID NO: 13061 - protein, 308 aa, Catharanthus roseus
MSASTPQYNLDSFKFQPIKESIVSREMTRRYMMDMITYADTDVVIVGAGSAGLSCAYEISKNPNIRVAIIEQSVSPGGGAWLGGQLFSAMVVRKPAHKFLDELEIEYDEQDNYVVIKHAALFTSTIMSKLLARPNVKLFNAVAAEDLIVKGNRVAGVVTNWALVSMNHDTQSCMDPNVMEAKVVVSSCGHDGPFGATGVKRLRSIGMIDSVPGMKALDMNAAEDAIVRLTREIVPGMIVTGMEVAEIDGSPRMGPTFGAMMISGQKAAHLALRALGQPNALDGTQREVGIAQPELIFAAAETDDIVDA

SEQ ID NO: 13062 - protein, 356 aa, Lupinus angustifolius
MATSTLTSSLVTSNPKTSSFHGTPIPSRITSIKSIPQQNNNNNNTNIISMSLSTQSYDLNSFKFQPIKESTVSREMTRRYMTDMITYADTDVIVVGAGSAGLSCAYELSKNPNISVAIIEQSVSPGGGAWLGGQLFSAMVVRKPAHRFLDELEIEYDEQEDYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNAAEDAIVKLTREIVPGMIVTGMEVAEIDGSPRMGPTFGAMMISGQKAAHLALKALGKNNAIDGTYEVGVEAPDLVLASAETQDIVDA

SEQ ID NO: 13063 - protein, 358 aa, Lupinus angustifolius
MAAMATSLTPSHISSNLKHSSFHGTPISSCINSTTRQHNNNNNNNMNKTISMSLNSPPYDLNSFKFKPIKESIVSREMTRRYMTDMITYADTDVIVVGAGSAGLSCAYELSKNPNISVAIIEQSVSPGGGAWLGGQLFSAMVVRKPAHRFLDELEIEYDEQEDYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNAAEDAIVKLTREIVPGMIVTGMEVAEIDGSPRMGPTFGAMMISGQKAAHLALKALGKDNAIDGTYEVGAEAPQLVLASAETKEIVDA

SEQ ID NO: 13064 - protein, 358 aa, Eschscholzia californica
MAAMTTSLLSSKPKSPFLEKESSFHGISIPSSRSSIQPIRSTNKATTISISASNPPPYDLQSFKFNPIKESIVSREMTRRYMMDMITYADTDVIVVGAGSAGLSCAYEISKNPNVRVALIEQSVSPGGGAWLGGQLFSAMVVRKPAHKFLDELEIEYDEQDHYVVIKHAALFTSTIMSKLLARPNVKLFNAVAAEDLIVKEGKVAGVVTNWALVSMNHDTQSCMDPNVMESKIVVSSCGHDGPFGATGVKRLKSIGLIDSVPGMKALDMNTAEDAIVRLTREIVPGMIVTGMEVAEIDGAPRMGPTFGAMMISGQKAAHLALKALGQPNVIDGNYKELENIHPELILAAAEASDIVDA

SEQ ID NO: 13065 - protein, 358 aa, Eschscholzia californica
MAAMTTSLLSSKPKSPFLEKESSFHGISIPSSRSSIQPIRSTNKTTTISISASNPPPYDLQSFKFNPIKESIVSREMTRRYMMDMITYADTDVIVVGAGSAGLSCAYEISKNPNVRVALIEQSVSPGGGAWLGGQLFSAMVVRKPAHKFLDELEIEYDEQDHYVVIKHAALFTSTIMSKLLARPNVKLFNAVAAEDLIVKEGKVAGVVTNWALVSMNHDTQSCMDPNVMESKIVVSSCGHDGPFGATGVKRLKSIGLIDSVPGMKALDMNTAEDAIVRLTREIVPGMIVTGMEVAEIDGAPRMGPTFGAMMISGQKAAHLALKALGQPNVIDGNYKELENIHPELILAAAEASDIVDA

SEQ ID NO: 13066 - protein, 218 aa, Sarracenia psittacina
MVVRKPAHLFLDELGIDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGLPNAVDGTYVGSIQPELILASADAAAETVDA

SEQ ID NO: 13067 - protein, 357 aa, Eschscholzia californica
MAAMATSLLSSKPKSPFLEKESSFHGIQIPSRSSIQPIRSTTHQNSSISASNPPQPYDLQSFKFNPIKESIVSREMTRRYMMDMITYADTDVIVVGAGSAGLSCAYEISKNPNVRVALIEQSVSPGGGAWLGGQLFSAMVVRKPAHKFLDELEIEYDEQDHYVVIKHAALFTSTIMSKLLARPNVKLFNAVAAEDLIVKEGKVAGVVTNWALVSMNHDTQSCMDPNVMESKIVVSSCGHDGPFGATGVKRLKSIGLIDSVPGMKALDMNTAEDAIVRLTREIVPGMIVTGMEVAEIDGAPRMGPTFGAMMISGQKAAHLALKALGQPNVIDGNYEELGSIQPELILAAAESAEIVDA

SEQ ID NO: 13068 - protein, 356 aa, Vinca minor
MAAMATTLTSSSPKPTFLETKSSFYGSPVLSRVVVQPIKSTSQNSPISMSATTPDYNLDSFKFSPIKESIVSREMTRRYMMDMITYADTDVVIVGAGSAGLSCAYEISKNPNINVAIIEQSVSPGGGAWLGGQLFSAMIVRKPAHKFLDELEIEYDEQDNYVVIKHAALFTSTIMSKLLARPNVKLFNAVAAEDLIVKGNRVAGVVTNWALVSMNHDTQSCMDPNVMEAKIVVSSCGHDGPFGATGVKRLKSIGMIDSVPGMKALDMNAAEDAIVRLTREIVPGMIVTGMEVAEIDGSPRMGPTFGAMMISGQKAAHLALRALGQPNALDGTLGEMGIPQPDLILAAAESEDIVDA

SEQ ID NO: 13069 - protein, 350 aa, Citrus clementina
MAAMSTTLTSSLSSSPKSSFLDHKSSFHGSPIITSRVTPIRSSSQSQTHTISMSLTPQYDFNSFTFDPIKESIVSREMTRRYMTDMVTYADTDVIVVGAGSAGLSCAYEISKNPSIRVAIIEQSVSPGGGAWLGGQLFSAMVVRKPAQIFLDELGVEYDEQDNYVVIKHAALFTSTIMSKLLARPNVKLFNAVAAEDLIVKGGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKALGQPNAIDGTFSEVTEVQPELSCCH

SEQ ID NO: 13070 - protein, 354 aa, Sesamum indicum
MAAMAATLTSSLSKAQFFDNKSSFHGSPLSTRAVQPIKSAPQSLAITMSAAAPYNLDNFKFQPIKESIVSREMTRRYMTDMITYADTDVVVVGAGSAGLSCAYELSKNPNINIAIIEQSVSPGGGAWLGGQLFSAMVVRKPAHKFLDELEVEYDEQDNYVVIKHAALFTSTIMSKLLARPNVKLFNAVAAEDLIVKGGRVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALRALGQPNALEGSYREVKTGVEEFMLASAESDETVDA

SEQ ID NO: 13071 - protein, 357 aa, Populus trichocarpa
MATMATTLTSLSTKSQKLSPFDTSSSFHGTPISKPTLRMQPTKSSSSPNVSISMSSPPYDLNAFKFEPIKESIVSREMTRRYMMDMITHADTDVVIVGAGSAGLSCAYELSKNPSVKIAIVEQSVSPGGGAWLGGQLFSAMVVRKPAHLFLDELGIEYDEQEDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNAAEDAIVKLTREVVPGMIVTGMEVAEIDGSPRMGPTFGAMMISGQKAAHLALKSLGMPNALDGTFVGGIHPELILAAVESADIAET

SEQ ID NO: 13072 - protein, 349 aa, Quercus alba
MATMASTLTSKPQTLAFFDSSSFHGTPLAPPSSLRVHQPAKSSVAPHAISMSASPPPYDLKGFAFEPIKESIVSREMTRRYMTDMITYADTDVVVVGAGSAGLSCAYELSKNPSVQVAIIEQSVSPGGGAWLGGQLFSAMPAHLFLDELEIEYDEQDNYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGLPNALDAEAIHPELILAAADSAEIAEA

SEQ ID NO: 13073 - protein, 352 aa, Vinca minor
MATTLTSSPKPTFLETKSSFHGSPVLSRVVQPIKSTSQNPSPITMSATTPNYNLDSFKFNPIKESIVSREMTRRYMMDMITYADTDVVIVGAGSAGLSCAYEISKNPNINVAIIEQSVSPGGGAWLGGQLFSAMVVRKPAHKFLDELEIEYDEQDNYVVIKHAALFTSTIMSKLLARPNVKLFNAVAAEDLIVKGNRVAGVVTNWALVSMNHDTQSCMDPNVMEAKIVVSSCGHDGPFGATGVKRLKSIGMIDSVPGMKALDMNAAEDAIVRLTREIVPGMIVTGMEVAEIDGSPRMGPTFGAMMISGQKAAHLALRALGQPNALDGTLGEMGIAQPDLILAAAENEEIVDA

SEQ ID NO: 13074 - protein, 353 aa, Scabiosa columbaria
MATMATLTSSLSSVSSKTNSSYGIPTFSQPRLRSVRSTPQNLSLSISMSASSRPYDLNAFEFSPIKESIVSREMTRRYMTDMITFADTDVVVVGAGSAGLSCAYELSKNPDVQVAIIEQSVSPGGGAWLGGQLFSAMIVRKPAHHFLDELEIDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNTAEDAIVRLTREIVPGMIVTGMEVAEIDGSPRMGPTFGAMMISGQKAAHLALKALGLPNALDGNYVGSVQPELILAAADAADIVDA

SEQ ID NO: 13075 - protein, 353 aa, Ambrosia trifida
MASMTTTFTSSFSNKTCFLDQSSFHGVPITSPVRIQPVKSNQNKNMPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQEDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVKLTREIVPGMIVTGMEVAEIDGSPRMGPTFGAMMISGQKAAHLALKALGLPNALDGTSVGSVHPELILAAADSSETVDA

SEQ ID NO: 13076 - protein, 352 aa, Mimulus guttatus
MATMASALASKPSFFDTHKTSFNGQPISPAVRRRRQATRSAKPNGSPISMSSASSPPGYDLNQFRFAPIKESIVSREMTRRYMTDMITYADTDVVVVGAGSAGLSCAYELSKNPSVRVAIIEQSVSPGGGAWLGGQLFSAMVVRKPAHLFLDELGLEYDEQDNYVVIKHAALFTSTIMSKLLARPNVKLFNAVAAEDLIVKGGRVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHIALQSLGLANNVGSIHPEMVLAAVDDAEILDA

SEQ ID NO: 13077 - protein, 355 aa, Echinacea purpurea
MASMATTFASSLSTKPNTSFFDQSSFYGVPVSSPIRIQPVKSSHNKNTPISMSATPYDLGSFTFQPIKESIVSREMTRRYMTDMITYADTDVVVVGAGSAGLSCAYELSKNPNVQVAIIEQSVSPGGGAWLGGQLFSAMVVRKPAHHFLDELEIEYDEQEDYVVIKHAALFTSTIMSKLLARPNVKLFNAVAAEDLIIKGGRVGGVVTNWALVTMNHDTQSCMDPNVMEAKVVVSSCGHDGPMGATGVKRLRSVGMIESVPGMKALDMNTAEDEIVKMTREVVPGMIVTGMEVAEIDGSPRMGPTFGAMMISGQKAAHLALKALGLPNALDGTLVGTVQPELMLAAADSGESVDA

SEQ ID NO: 13078 - protein, 357 aa, Gossypium raimondii
MASSIATTLTSSSKLCRNTSLFESSFHGVPIKPLSFHFKTKSSPCNASISMSAASPPPYDLNNFRFDPIKESIVSREMTRRYMMDMITYADTDVVVVGAGSAGLSCAYELSKNPSVQIAIVEQSVSPGGGAWLGGQLFSAMVVRKPAHRFLDELAIEYDEQDDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALKSLGLPNAIDGTYVGSIHPELILAAADSAETADA

SEQ ID NO: 13079 - protein, 354 aa, Vaccinium corymbosum
MASVTATLTSSLSTKPKTSFLDTQSSSFHGFRPTKAAAAPHNNHLSISMSASPPPYDLKSFKFDPIKESIVSREMTRRYMMDMITYADTDVVVVGAGSAGLSCAYELSKNPSVQVAIIEQSVSPGGGAWLGGQLFSAMVVRKPAHRFLDELEIEYDEQDTYVVIKHAALFTSTIMSKLLARPNVKLFNAVAAEDLIVKEGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKSLGLPNALDGTSVGSVHPELILASVDGAETVDA

SEQ ID NO: 13080 - protein, 352 aa, Vaccinium corymbosum
MATMVTTFAPSLSSNPKTSFFESSQSRRLQPIKSTPHNHNHLTVSMSAAASPPYDLKSFKFDPIKESIVSREMTRRYMMDMITYADTDVVVVGAGSAGLSCAYELSKNPSVQVAIIEQSVSPGGGAWLGGQLFSSMVVRKPAHLFLDELNIEYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNAAEDAIVRLTREIVPGMIVTGMEVAEIDGSPRMGPTFGAMMISGQKAAHLALKSLGLPNAVDGTYVGSTHPELILASADAVETVDA

SEQ ID NO: 13081 - protein, 359 aa, Tropaeolum majus
MATIASTLSLSTSKTQKLSRFDSSFYGVPVNQSLPFRAKSPNTARLAVSASAAGQPSSPPYDLNSFTFDPIKESIVSREMTRRYMTDMITYADTDVVVVGAGSAGLTCAYEISKNPSVQVAIIEQSVSPGGGAWLGGQLFSAMVVRKPAHLFLDELNIEYDEQDNYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNKAEDAIVRLTREIVPGMIVTGMEVAEIDGAPRMGPTFGAMMISGQKAAHIALQKLGLPNALDGTYVGSVQPELILAAAESAEIVDA

SEQ ID NO: 13082 - protein, 361 aa, Coffea canephora
MASMATATFTSTLSSKPRTTLFGNSRSSFHGLPVSSSPHLQPIKSTPQNSSLISMSASATPPYDLQSFTFDPIKESIVSREMTRRYMMDMITYADTDVVIVGAGSAGLSCAYELSKNPSVQVAIIEQSVSPGGGAWLGGQLFSAMVVRKPAHLFLDELGVDYDEQDNYVVIKHAALFTSTIMSKLLARPNVKLFNAVAAEDLIVKGSRVGGVVTNWALVSMNHDTQSCMDPNVVEAKVVVSSCGHDGPFGATGVKRLKSIGMIENVPGMKALDMNAAEDAIVRLTREIVPGMIVTGMEVAEIDGAPRMGPTFGAMMISGQKAAHLALRSLGLPNALDGTYAGSIHPELILAAADASETVDA

SEQ ID NO: 13083 - protein, 351 aa, Fraxinus spp
MATMASTLAPKTTFLDANKSSFNGIPISSPIRVQPIKSTSQNLSISASSPPYDLKSFEFQPIKESIVSREMTRRYMMDMITYADTDVVIVGAGSAGLSCAYELSKNPSVQVAIIEQSVSPGGGAWLGGQLFSAMVVRKPAHHFLDELEIEYDEQDDYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMIDNVPGMKALDMNTAEDAIVRLTREIVPGMIVTGMEVAEIDGAPRMGPTFGAMMISGQKAAHLALRSLGLPNELDGTNVGNVQPELILAAADDGTEIVEA

SEQ ID NO: 13084 - protein, 354 aa, Ipomoea nil
MAAATLTSSLSSKLKPSFFDAAKSSFNGTPVVSSRVQAVKASSHHNLSVSASHTPYSLDSFKFQPIKESIVAREMTRRYMTDMITYADTDVIVVGAGSAGLSCAYEISKNPNVRVAIIEQSVSPGGGAWLGGQLFSAMVVRKPAQVFLDELEVEYEEADNYVVIKHAALFTSTIMSKLLARPNVKLFNAVAAEDLIVKNGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKALGEPNALDGSASEVAAPELILASAENEEIADA

SEQ ID NO: 13085 - protein, 351 aa, Mimulus guttatus
MAAMATTLRSSLTKTSFFDNKSTFHGAAVVPTRAAQPIKSTPKNLAVAMASTPYNLDDFKFQPIKESIVAREMTRRYMTDMITYADTDVVVVGAGSAGLSCAYELSKNPDINIAIIEQSVSPGGGAWLGGQLFSAMVVRKPAHKFLDELEIEYDEQDHYVVIKHAALFTSTIMSKLLARPNVKLFNAVAAEDLIVKGGRVAGVVTNWALVAQNHHTQSCMDPNVMEAKIVVSSCGHDGPFGATGVKRLRSIGMIESVPGMKALDMNTAEDAIVRLTREIVPGMIVTGMEVAEIDGSPRMGPTFGAMMISGQKAAHLALKALGLPHALDGSYSEAQPELVLASAEADDVVEA

SEQ ID NO: 13086 - protein, 353 aa, Lippia dulcis
MAAMATALTSSLSKTAFFDTRSAFHGTTLPTRAAAQPARSTPQNPAITMSAAPYNLDNFKFQPIKESIVSREMTRRYMTDMITYADTDVVVVGAGSAGLSCAYELSKNPDINVAIIEQSVSPGGGAWLGGQLFSAMVVRKPAHKFLDELEIEYDEQGDYVVIKHAALFTSTIMSKLLARPNVKLFNAVAAEDLIVKGGRVAGVVTNWALVSMNHDTQSCMDPNVMEAKVVVSSCGHDGPFGATGVKRLRSIGMIDSVPGMKALDMNAAEDAIVKLTREIVPGMIVTGMEVAEIDGSPRMGPTFGAMMISGQKAAHLALKALGQPNALEGSYGGVKAEAELLLASAESDETVDA

SEQ ID NO: 13087 - protein, 363 aa, Panax ginseng
MATMATTFASSLSSKPKTTNFLESSFNGVSISTASRLQPIKSGQQNHQFTVSAFSSPPYDLKSFKFEPIKESIVSREMTRRYMTDMITYADTDVVVVGAGSAGLSCAYELSKTPSVQVAIIEQSVSPGGGAWLGGQLFSSMVVRKPAHHFLDELEIEYDEKDTYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMISSVPGMKALDMNTAEDAIVRLTREIVPGMIVTGMEVAEIDGAPRMGPTFGAMMISGQKAAHLALMALGQPNALDGTYVGGIQAELIVATADATEIVDAQVLKQI

SEQ ID NO: 13088 - protein, 363 aa, Panax ginseng
MATMATTFASSLSSKPKTTNFLESSFNGVSISTASRLQPIKSGQQNHQFTVSAFSSPPYDLKSFKFEPIKESIVSREMTRRYMTDMITYADTDVVVVGAGSAGLSCAYELSKTPSVQVAIIEQSVSPGGGAWLGGQLFSSMVVRKPAHHFLDELEIEYDEKDTYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMISSVPGMKALDMNTAEDAIVRLTREIVPGMIVTGMEVAEIDGAPRMGPTFGAMMISGQKAAHLALKALGQPNALDGTYVGGIQAELIVATADAAEIVNAQVLKQI

SEQ ID NO: 13089 - protein, 368 aa, Ipomoea nil
MATMASTLAASSSVSKTSFLDAHKSFFHGTPAVSSQPARSFTQPLKSPISRNMAISMSASSASASTPPPYDLKSFTFEPIKESIVSREMTRRYMTDMITYADTDVIVVGAGSAGLSCAYELSKNPNVQVAIIEQSVSPGGGAWLGGQLFSAMVVRKPAHLFLDELGVEYDEQDNYVVIKHAALFTSTIMSKLLSRPNVKLFNAVAAEDLIVKGGRVGGVVTNWALVSMNHDTQSCMDPNVMEAKVVVSSCGHDGPFGATGVKRLKSIGMIESVPGMKALDMNTAEDAIVRLTREIVPGMIVTGMEVAEIDGAPRMGPTFGAMMVSGQKAAHLALKSLGMANAIDGDEVGSIHPQLIMAAADDSEVVDA

SEQ ID NO: 13090 - protein, 360 aa, Elaeis guineensis
MATMATSSLASKPKTSLLDHHHHHSSFHGLALPSRVSAAAAGRSPNSRSLFISASAATPKYDLNSIRFDPIKESIVSREMTRRYMTDMITHADTDVVVIGAGSAGLSCAYELSKDPSVQVAIVEQSVSPGGGAWLGGQLFSAMVVRKPAHLFLDELGVPYDEQDSYVVIKHAALFTSTIMSRLLARPNVKLFNAVAAEDLIVKEGRVGGVVTNWALVSMNHDTQSCMDPNVMESKVVVSSCGHDGPFGATGVKRLKDIGMIDSVPGMKALDMNSAEDAIVRLTREIVPGMIVTGMEVAEIDGAPRMGPTFGAMMISGQKAAHLALKALGRPNALDGTIGTEQVHPEMVLASSDGGDVVDA

SEQ ID NO: 13091 - protein, 73 aa, Ambrosia trifida
MASMTTTFTSSFSNKTCFLDQSSFHGVPITSPVRIQAVKSNQNKNMPITMSATPYDLVHSPFNPSRRRSYPVK

SEQ ID NO: 13092 - protein, 127 aa, Flaveria ramosissima
MNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGVFNLS

SEQ ID NO: 13093 - protein, 351 aa, Olea europaea
MATMASTLASKTTFLDANKSSFNGVPISSPTRVQPIKSTSQNLSISASSPPYDLKSFEFQPIKESIVSREMTRRYMMDMITYADTDVVIVGAGSAGLSCAYELSKNPSVRVAIIEQSVSPGGGAWLGGQLFSAMVVRKPAHHFLDELEIEYDEQDDYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDNVPGMKALDMNTAEDAIVRLTREIVPGMIVTGMEVAEIDGAPRMGPTFGAMMISGQKAAHLALRTLGLPNELDGTNVGNVQPELILAAADDGNEIVEA

SEQ ID NO: 13094 - protein, 364 aa, Cichorium intybus
FIIIPYHYWRPVATTLTTSLSTKVKTSFLDQSSFHGVPISSPIRFQSLKSTQNKMSINMSAASTPYDLNSFTFQPIKESIVSREMTRRYMTDMITYADTDVVVVGAGSAGLSCAYELSKNPNVQVAIIEQSVSPGGGAWLGGQLFSAVVVRKPAHLFLDELEIEYDEQEHYVVIKHAALFTSTIMSKLLARPNVKLFNAVAAEDLIIKGGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGSYVGSGQPELILAAVDGGDTVEA

SEQ ID NO: 13095 - protein, 330 aa, Flaveria ramosissima
MAFRSHLRSGSTHPNQTKTRPPPLTMSAAPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSGETVVDA

SEQ ID NO: 13096 - protein, 356 aa, Citrus clementina
MAAMTSTAFAPSVSSTTNKLFDSSFHGAPMSPSLLRLQPIKSSRPNNLSISASASPPYDLNTFKFDPIKESIVSREMTRRYMTDMITYADTDVVVVGAGSAGLSCAYELSKNPNIQIAIIEQSVSPGGGAWLGGQLFSAMVVRKPAHIFLDELGIDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIEEVPGMKALDMNSAEDAIVRLTREVVPGMIVTGMEVAEIDGAPRMGPTFGAMMISGQKAAHLALNSLGQPNALDGTYVGGVHPELILAAADSAETADA

SEQ ID NO: 13097 - protein, 351 aa, Flaveria ramosissima
FTSSLCNKTKTKTSFFDQSSFHGVPVSSPIRIHSPKSNQNRTTPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSGETVVDA

SEQ ID NO: 13098 - protein, 356 aa, Lactuca sativa
MAAMATTFTTSISTKAKTSFLEQSSFHGVQISSPIRLQPLKSTQNKMSITISAASTPYDLNSFTFQPIKESIVSREMTRRYMTDMITYADTDVVIVGAGSAGLSCAYELSKNPDVQVAIIEQSVSPGGGAWLGGQLFSAMIVRKPAHLFLDELEIEYDETEHYVVIKHAALFTSTIMSKLLARPNVKLFNAVAAEDLIIKGGRVGGVVTNWALVAMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGSYVGSSQPELILAAADGGETVDA

SEQ ID NO: 13099 - protein, 359 aa, Flaveria ramosissima
AGSSPKPTLHLTLLYATNTKTSFFDQSSFHGVPISSPIRIHSPKSNQNKTTPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSGETVVDA

SEQ ID NO: 13100 - protein, 353 aa, Scabiosa columbaria
MATMATLTSSLSSVSSKTNSSYGIPTFSQPRLRSVRSTPQNLSLSISMSASSTPYDLNAFEFSPIKESIVSREMTRRYMTDMITFADTDVVVVGAGSAGLSCAYEISKNPDVQVAIIEQSVSPGGGAWLGGQLFSAMIVRKPAHHFLDELEIEYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNTAEDAIVRLTREIVPGMIVTGMEVAEIDGSPRMGPTFGAMMISGQKAAHLALKALGLPNALDGNYVGSVQPELILAAADAADTVDA

SEQ ID NO: 13101 - protein, 353 aa, Fagus grandifolia
MATMASTLISKPQRLALFDTSSSFHGTPLAPPSSLRVNQPIKSGHAISMSASSQYDLKEFTFEPIKESIVSREMTRRYMMDMITYADTDVVVVGAGSAGLSCAYELSKNPSVQVAIIEQSVSPGGGAWLGGQLFSAMVVRKPAHLFLDELNIDYDEQDNYVVIKHAALFTSTIMSKLLARPNVKLFNAVAAEDLIVKGGRVGGVVTNWALVSMNHNTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALQSLGLPNALDGSYVGSIRPELILAAADAAEIADA

SEQ ID NO: 13102 - protein, 350 aa, Cirsium arvense
MASMTTTFSSSLSTKVKTSSFHGVPVASPIRIQSIKSLSNQNKTMPITMSYDLGSFTFRPIKEAIVSREMTRRYMTDMITYADTDVVVVGAGSAGLSCAYELSKNPNVQVAIIEQSVSPGGGAWLGGQLFSAMVVRKPAHLFLDELNIEYDEQEDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGLIESVPGMKALDMNTAEDAIVRLTREIVPGMIVTGMEVAEIDGSPRMGPTFGAMMISGQKAAHLALKALGLPNALDGTLTGSSIHPEMILAAADSGETVDA

SEQ ID NO: 13103 - protein, 345 aa, Lippia dulcis
MATALTSSLSKTQFFDNKSSFHGTPIPSRAAQSVKSSPQNLSITMSATDSYNLSNFKFQPIKESIVSREMTRRYMTDMITYADTDVVVVGAGSAGLSCAYELSKNPDINVAIIEQSVSPGGGAWLGGQLFSAMVVRKPAHKFLDELEIEYDEQDDYVVIKHAALFTSTIMSKLLARPNVKLFNAVAAEDLIVKGGRVAGVVTNWALVSMNHDTQSCMDPNVMEAKVVVSSCGHDGPFGATGVKRLRSIGMIDSVPGMKALDMNAAEDAIVELTREIVPGMIVTGMEVAEIDGSPRMGPTFGAMMISGQKAAHLALQALGLPNALEGASVPELILASTDPDETVDA

SEQ ID NO: 13104 - protein, 357 aa, Gossypium hirsutum
WQPWQQLSPHCSFKPQTIFPRPQQVILQRHSNSFSLHSHQVPLHTTSAISMSLTPPYDLQSFEFQPIKESYVSREMTRRYMMDMITYADTDVIIVGAGSAGLSCAYEISKNPNIRVAIIEQSVSPGGGAWLGGQLFSAMVVRKPAHRFLDELGIQYDEQEDYVVIKHAALFTSTIMSKLLARPNVKLFNAVAAEDLIVKGNRVAGVVTNWALVSMNPDTQSCMDPNVMEFKVVVSFCGHDGPFGATGVKRLKSIGMIDSVPGMKALDMNPAGDAIVRLPREIVPGMFVTGMEVAEIDGAPRMGPPFGAMMISGRKAAPLPLKALGQPNPVDGPFREAERVHPEFFLAAAETEGTVDA

SEQ ID NO: 13105 - protein, 349 aa, Cynara scolymus
MATTFASSLSTKPNTCFFDQSSFHGVPVASPIRIQPIKSHHNKTMPITMSYDLGSFTFRPIKEAIVSREMTRRYMTDMITYADTDVVVVGAGSAGLSCAYELSKNPNVQVAIIEQSVSPGGGAWLGGQLFSAMVVRKPAHLFLDELNIEYDEQEDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGLIESVPGMKALDMNAAEDAIVRLTREIVPGMIVTGMEVAEIDGSPRMGPTFGAMMISGQKAAHLALKALGLPNALDGTLTGSIHPELILAAADSGESVDA

SEQ ID NO: 13106 - protein, 358 aa, Flaveria ramosissima
MASMTTTFTSSLCNKTKTKTSFFDQSSFHGVPISSPIRIHSPKSNQNKTTPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDEYVVIKHAALFTSTIMSKLLARPNVKLFNAVAAEDLIIKEGRVGGVVTNWALVSMNHNTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSAETVVDA

SEQ ID NO: 13107 - protein, 352 aa, Flaveria ramosissima
TTTFTSSLCNKTKTSFFDQSSFHGVPISSPIRIHSPKSNQNKTTPITMSAAPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSGETVVDA

SEQ ID NO: 13108 - protein, 346 aa, Flaveria ramosissima
SLCNKTKTSFFDQSSFHGVPISSPIRIHSPKSNQNKTTPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILAAADSGETVVDA

SEQ ID NO: 13109 - protein, 380 aa, Aristolochia fimbriata
SFPHLPAPLKTLAKALEGIDDGSSRHRHHLHVSSLHQAQGSLLRWIFVLPWRPHRPRLPAGRSSSNAAAPSVSISASASKYDLQALRFEPIKESIVSREMTRRYMMDMITYADTDVVVVGAGSAGLSCAYELSKNPNVRVAIIEQSVSPGGGAWLGGQLFSAMVVRKPAHLFLDELEIEYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNTAEDEIVRLTREIVPGMIVTGMEVAEIDGSPRMGPTFGAMMLSGQKAAHLALKALGLPNAVDGTYQLGSPHPELVLASAEVDGVVEA

SEQ ID NO: 13110 - protein, 346 aa, Flaveria ramosissima
SSLCNNTKTSFFDQSSFHGVPISSPIRIQSPKSNHNKTTPITMSATPYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQDDYVVIKHAALFTSTIMSKLLARPNVKLFNAVAAEDLIIKEGRVGGVVTNWALVSMNHDTQSCMDPNVMEAKVVVSSCGHDGPMGATGVKRLRSVGMIESVPGMKALDMNTAEDAIVRLTREIVPGMIVTGMEVAEIDGSPRMGPTFGAMMISGQKAAHLALKALGLPNALDGTSVGSVQPELILALRILVRPWSM

SEQ ID NO: 13111 - protein, 350 aa, Vaccinium corymbosum
MASVTATLTSSLSTKPKTSFLDTQSSSSFHGFRPTKAAAAPHNNHLSISMSYDLKSFKFDPIKESIVSREMTRRYMMDMITYADTDVVVVGAGSAGLSCAYELSKNPSVQVAIIEQSVSPGGGAWLGGQLFSAMVVRKPAHRFLDELEIEYDEQDTYVVIKHAALFTSTIMSKLLARPNVKLFNALAAEDLIVKEGRVGGVVTNWALVSMNHDTQSCMDPNVMEAKIVVSSCGHDGPFGATGVKRLKSIGMIDSVPGMKALDMNTAEDAIVRLTREIVPGMIVTGMEVAEIDGAPRMGPTFGAMMISGQKAAHLALKSLGLPNALDGTYVGSVHPELILASVDGAETVDA

SEQ ID NO: 13112 - protein, 359 aa, Panax ginseng
MATTFASSLSSKPKTTNFLESSFNGVSISTASRLQPIKSGQQKHQFTVSAFSSPPYDLKSFKFEPIKESIVSREMTRRYMTDMITYADTDVVVVGAGSAGLSCAYELSKNPSVQVAIIEQSVSPGGGAWLGGQLFSSMVVRKPAHHFLDELEIEYDEKDTYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMISSVPGMKALDMNTAEDAIVGLTREIVPGMIVTGMEVAEIDGAPRMGPTFGAMMISGQKAAHLALKALGQPNALDGTYVGGIQEELILATADAAEIVDAQVLKQ

SEQ ID NO: 13113 - protein, 353 aa, Vitis vinifera
MATLTSSICSKPKASVFDPHKSSFHGVPIATQARLSPVKSTPVNLAVTAAAMPYDLRSFKFEPIKESIVSREMTRRYMMDMITYADTDVVVVGAGSAGLSCAYELSKNPSVQVAIIEQSVSPGGGAWLGGQLFSSMVVRKPAHRFLDELGLEYDEQDNYVVIKHAALFTSTIMSKLLARPNVKLFNAVAAEDLIIKEGKVGGVVTNWALVSMNHDTQSCMDPNVMEAKVVVSSCGHDGPFGATGVKRLRSVGMIDSVPGMKALDMNTAEDEIVRLTREVVPGMIVTGMEVAEIDGSPRMGPTFGAMMISGQKAAHLALKSLGLPNALDGTYIGNLHPELVLAAAADAAEIAEA

SEQ ID NO: 13114 - protein, 358 aa, Theobroma cacao
MASSVATTLTSSTKLYRNTSLFESSFHGVPITPLSFHLKAKSSPRNASVSMSAASSPPPYDLNNFRFDPIKESIVSREMTRRYMMDMITHADTDVVVVGAGSAGLSCAYELSKNPSVQVAIVEQSVSPGGGAWLGGQLFSAMVVRKPAHRFLDELGIEYDEQDDYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALQSLGLPNALDGTYVGNIHPELILAAADSAETADA

SEQ ID NO: 13115 - protein, 344 aa, Artemisia annua
MASMTTTFTSPLYTKTQSSFHGVPVVRMIQPVKSSNKTNTPITMSYDLGSFTFQPIKEAIVSREMTRRYMTDMITYADTDVVVVGAGSAGLSCAYELSKNPNVQVAIIEQSVSPGGGAWLGGQLFSAMVVRKPAHHFLDELEIEYDEQEDYVVIKHAALFTSTIMSKLLARPNVKLFNAVAAEDLIIKGGRVGGVVTNWSLVAQNHDTQSCMDPNVMEAKVVVSSCGHDGPMGATGVKRLRSVGLIESVPGMKALDMNTAEDAIVKLTREIVPGMIVTGMEVAEIDGSPRMGPTFGAMMISGQKAAHLALKALGLPNALDGTLVGSLHPELILAAADSSETVDA

SEQ ID NO: 13116 - protein, 358 aa, Musa acuminata
MAASVATSSLLSNPKSLISDNHHRSSFSGFRLPATALRSLPGRGRPSLSVTAASAAPRYDLDSFRFEPIKESVVSREMTRRYMTDMITYADTDVVVIGAGSAGLSCAYEISKDPSVRVAIVEQSVSPGGGAWLGGQLFSAMVVRKPAHLFLDELGVAYDEADSYVVIHHAALFTSTIMSRLLARPNVKLFNAVAAEDLIVKEGRVAGVVTNWALVSMNHDTQSCMDPNVMEARVVVSSCGHDGPFGATGVKRLKGIGMIDSVPGMKALDMNAAEDAIVRLTREVVPGMIVTGMEVAEIDGAPRMGPTFGAMMISGQKAAHLALKALGRPNAIDGTIGAEAVQPELVLASSDAGEIVDA

SEQ ID NO: 13117 - protein, 355 aa, Lactuca sativa
MASMATTFASSLSTKTRTSFLDQSSFHGVPVASPTRIQPIKSNQSKNTPITMSATPYDLGSFTFSPIKEAIVSREMTRRYMTDMITYADTDVVVVGAGSAGLSCAYELSKNPDVQVAIIEQSVSPGGGAWLGGQLFSAMVVRKPAHLFLDELEIEYDEQEDYVVIKHAALFTSTIMSKLLARPNVKLFNAVAAEDLIIKGGRVSGVVTNWALVAMNHDTQSCMDPNVMEAKVVVSSCGHDGPMGATGVKRLRSVGLIESVPGMKALDMNAAEDAIVKLTREIVPGMIVTGMEVAEIDGSPRMGPTFGAMMISGQKAAHLALRALGLPNALDGTSVGSVHPEMILAAVDSGETVDA

SEQ ID NO: 13118 - protein, 358 aa, Nicotiana benthamiana
MATMASTLASSVVTKTNFLDTHKSSFSGVPLFSQARLKPVKSAQQNMTISMSADSSPPPYDLNAFSFNPIKESIVSREMTRRYMTDMITYADTDVVIVGAGSAGLSCAYEISKNPNVQVAILEQSVSPGGGAWLGGQLFSAMVVRKPAHLFLNELGIDYDEQDNYVVIKHAALFTSTIMSKLLARPNVKLFNAVATEDLIVKNGRVGGVVTNWSLVSQNHDTQSCMDPNVMEAKIVVSSCGHDGPMGATGVKRLKSIGMINHVPGMKALDMNTAEDAIVRLTREVVPGMIVTGMEVAEIDGAPRMGPTFGAMMISGQKAAHLALRALGLPNALDGTAESSIHPELILAAADDAETADA

SEQ ID NO: 13119 - protein, 128 aa, Vigna unguiculata
MSKKGGSGASFQKDVPWRASSSTAKPLPKIHLSPLLRVSQTPVTDYAVSVMRHPDPIGSGLGDEAIVEAAGPDCLVPGQKMPLQLLGLQVWPIHVDLKFLEPVGRELKMLGKFMDDAVELMNKSFIER

SEQ ID NO: 13120 - protein, 124 aa, Glycine max
MSKGGSLQKDVPWRASSSSAKPIPKIHHSPLLRVSQTPVSDYGISVMRHPDPIGGGLGHEAIVEPAGPDCLVPGQKMPIQLLGLQVWPIHVDLKFLEPVGRELKMLGKFMDDAVELMNKSFIER

SEQ ID NO: 13121 - protein, 125 aa, Cajanus cajan
MSKKGGSFQKDVPWRASSSSLKPFPKIHHSPLLRVSHSPLSDYAVSVMRHPDPIGNGLGDEAIVEAAGPDCIVPGQKVPLKLLGLQVWPIHVDLKFLEPVGRELKLLGKFMDDAVELMNKSFIER

SEQ ID NO: 13122 - protein, 124 aa, Glycine max
MSKGGSLQKDVPWRASSSSAKPIPRIHHSPLLRVSRTPVSDYGISVMRHPDPIGGGLGDEATVEPAGPDCLVPGQKMPIQLLGLQVWPIHVDLKFLEPVGRELKMLGKFMDDAVELMNKSFIER

SEQ ID NO: 13123 - protein, 127 aa, Cyamopsis tetragonoloba
MSRKGGAASFQKDAPWRASSSSVKPIPKIHHSPLLRVSQNPFSDYAISIMRHPDPVGSGLGDEAIVEAAGPECIVPGQITPLKLLGVKVWPINVDLRFLEPVGRELKLLGKFMDDAVELMNKSFIER

SEQ ID NO: 13124 - protein, 229 aa, Vigna unguiculata
KVHSFKPHTKTTRIGSARGVRISCKVKDCPVLDLGLDENVNSYGQFSAPVKPESKQSKEEEEEKQNYHVNVGYAIRTLREDFPDLFYRELSFDIYRDDIVFKDPMNTFIGIENYKSIFWALRFHGKIFFKALWVDISSVWQPVENVIMVRWTVHGIPRVLWESRGRFDGTSEYKLDKQGKIFEHRVDNIATNSPHRFKVLSVAELIQSIGCPSTARPTYFETSSHPERT

SEQ ID NO: 13125 - protein, 915 aa, Phaseolus vulgaris
MDLNKLLRDSENFTIQYLTEKGSILKIDMEKLVGSLPLHLSTLLMSAVRNEALFRYLLRGIRLLHSLCDLASRNSKFEQIMLDDVKIMEQLTDLVFYMLIVLGGYRKEYHAFSYMHLLHSTLVACNLHLLTGFISTQWQDIVHVLLAHPKVDIFMDAAFGSVRMVVSFLENTLVAYQEDVSVESNLTAGQIVYYLCQQCEASLQFLQSLCQQKLFKERLLKNKELCEKGSILFLARSILKLHIQPSFPSRVMAAISRLKAKILSILLSLCEAESISYLDEVASSARSLDLAKSVALEVFDLLKKAFGRDPGHLTADRSHPMGFVQLNAMRLADIFSDDSNFRSYMIICFTKVLTAIISLSHGDFLSCWCSSNLSEMEEDASLEYDIFAAVGWILDNTSPDVRNATNLEFNLVPNSMPKASYAHHRTSLFVKFFANLHCFVPNICEEQERNLFVLKVMECLQMDLSNLLPGFSFASDAPKAAIASKNLRSLLSHAESLIPNFLNVEDVQLLRVFFGELQSLFTSTGFGENQVQDSKFEESQSWDKISKFNINEHYQEAQSAVGFPPSLTGKEPADLNKKGSNFKEGMSENSAFPDMDQHNSRAEETNQGKGLNRQNQVDDKGIPGKTASGGARDMDKDAQNVETSGSDTSSAKGKNVVDHMDIGELSKSNERLKRTAVEENPEDEKIELSQRRKRKRTIMNDKQVLLIERALKDEPDMQRNAVSLQSWAEKLSVHGSEVTSSQLKNWLNNRKARLARTARDVRTAGGDADNPVLEKQRGPVPGSYDSPESPGDVSHVARIASGDNKPEPSLARFVDIGSPEFGRCNAGQYVVLVGVRGDEIGRGKVFQVHGKWYGKSLEELATCVVDICELKADKGMRLPYPSEATGNTFAEAETKLGVMRVLWGSNRVFPLRSEI

SEQ ID NO: 13126 - protein, 941 aa, Glycine max
MRIAKEESSSSAAQAISLISALKELQGVTALDLNKLLRDSENFTIHYLTEKGSLLKIDMEKLAGSLPLHLTTLLMSGVRDEALFRYLLRGIRLLHSLCELASRNSKFEQILLDDVKMMEQLTDLVFYMLIVLGGYRQEYRAFSYMHLMHSTLVACNLHLLTAFVSTQWQDIVHVLLAHPKVDIFMDAAFGSVRMIVSFLENALVAYHEDISVESNLTAEQMVYYLCQQCEASLQFLQSLCQQKMFKERLLKNKELCEKGSILFLAQSILKLHIQPSFPSRIMAAISRLKAKILSILLSLCEAESISYLDEVASSVRSLDLAKSVALEVFDLLKKAFGRDPGHLTADRSFPMGFVQLNAMRLADIFSDDSNFRSYMILCFTKVLTAIISLSHGDFLSCWCSSNLSETEEDASIEYDIFAAVGWILDNTSPDVRNATNLEFNLIPNSMPKASYAHHRTSLFVKFFANLHCFVPNICEEQERNLFVLKVMECLQMDLSNLLPGFSFASDAPKAAIASKNLRSLLSHAESLIPNFLNVEDVQLLRVFFGELQSLFTSTGFGENQVQDSKFDESLSWDKLSKFNMNEHYQEAQSAGGCPPSLTGKEHASLNKKGGNFKEGMSENSAFPDMDQHNTRAEETNQGKGLNKQNQVDDKGIPGKTASGGAREMDKDAQNVETSGSDSSSAKGKNVVDNMDNGELSKSNERLKRTAVEENPEDEKIELSQRRKRKRTIMNDKQVMLIERALKDEPDMQRNAASLQSWADKLSGHGSEVTSSQLKNWLNNRKARLARTARDVKAAAGDDNPVPEKQRGPVPGSYDSPGSPGDVSHVARIASGDNKSELARFVDIGSPEFGHCNAGQNVVLVGVRGDEIGRGKVFQVHGKWYGKSLEELSAHVVDISELKADKGMRLPYPSEATGNTFAEAETKLGVMRVLWGSNRVFALRPE

SEQ ID NO: 13127 - protein, 945 aa, Glycine max
MRIAKEESSSSAAQAISLISAVKELQGVTALDLNKLLRDSENFTIHYLTEKGSLLKIDMEKLVGSLPLHLTTLLMSAVRDEALFRYLLCGIRLLHSLCELASRNSKFEQIVLDDVKMMEQLTDLVFYMQIVLGGYRQEYCAFSYMHLMHSTLVACNLHLLTAFISTQWQDIVHVLLAHPKVNIFMDAAFGSVRMVVSFLENTLVAYHEDISVESNLTAEQMVYYLCQQCEASLQFLQSLCQQFFFKERLLKNKELCEKGSILFLAQSILKLHIQPSFPSRIMAAISRLKAKILSILLSLCEVESISYLDEVASSARSLDLAKSVALEVFDLLKKTFGRDPGHLTADRSFPMGFVQLNAMRLADIFSDDSNFRSYMILCFTKVLTAIISLSHGDFLSCWCSSNLLKMEEDASLEYDIFAAVGWILDYTSLDVRNATNLEFNLIPNSMPKASYAHHRTSLFVKFFANLHCFVPNICEEQERNLFVLKVMECLQMDLSNLLPGFSFASDAPKAAIASKNLHSLLSHAESLIPNFLNVEDVQLLRVFFGELQSLFTSTGFGENQVQDSKFEESLYWDKLSKFNRNEHYQKAQSAGGCPSSLTGKEHADLNKKGGNFKEGMSENSAFPDMDQHNTRAEDTNQGKGLNRLNQVDDKGIAGKTASGGAREMDKDAQNVETSGSDSSSAKGKNVVDNMDNGELSKSNERLKRTAVEENPEDEKIELSQRRKRKRTIMNDKQVMLIERALKDEPDMQRNAASLQSWADKLSGHGSEVTSSQLKNWLNNRKARLARTARDVKAAAGDDNPVPDKQRGPVPGSYDSPGSPGDVSHVARIASGDNKSEPSLALARFVDIGSPEFGHCNAGQYVVLVGVRQDEIGRGKVFQVHGKWYGKSLDELSAHVVDISELKADKGMRLPYPSEATGNTFAEAETKLGVMRVLWGSNRVFALPPE

SEQ ID NO: 13128 - protein, 939 aa, Cajanus cajan
MTGVWMFFNLPEQEISLKSAVKELQGVTALDLNKLLRDSENFTIHYLTEKGSLLKVDMEKLAVSLPLHLTSQLMSPVRDEAMFRYLLCGIRLLHSLCDLASRNSKFEQIFLDDVKMEEQLIDLVFYMLIVLSGYRQEYHAFSYMHLMHSTLVACNLHLLTGFLSTQWQDIVHVLLAHPKVDIFIDAAFGSVRMAVSFLENTLVAFHKDISVESNLTPEQIVYYLCQQCEASLQFLQSLCQQKLFKERLLKNKELCGKGSILFLAQSILKLHIQPSFSSRVMAAISRLKAKILSILLSLCEAESISYLDEVASSARSLDLAKSVALEVFDLLKKAFGRDPEHLAADRRHPMGFVQLNAMRLADIFSDDSNFRSYMILCFTKVLTAIISLSHGDFLSCWCSSNLPETEEDASLEYDIFSAVGWILDNTSPDVRNATNLEFNLIPNSMPKASYAHHRTSLFVKFFANLHCFVPNICEEQERNLFVLKVLECLQMDLSNLLPGFSFASDTPKAAIASKNLRSLLSHAESLIPNFLNVEDVQLLRVFFGELQTLFASTGFGENQVQDSKFEESLSWDKFSKFNINEQYQEAQSAGGCLSSLTGKEPADLNKKGGNFKEGMSENSAFPDIDQHNTRAEDTNQSKGLNRQNQVDDKGLHGKTAPGGARDMEKDAQNVETSGSDSSSAKGKNVVDHMDNGELSKSNERLKRTAIEENPEDEKIELSQRRKRKRTIMNDKQVMLIERALKDEPDMQRNAASLQSWADKLSLHGSEVTSSQLKNWLNNRKARLARTARDVRAAAGDADNPVPDKQRGPVPGSYDSPDSPGDVSHARNDNKPEPSLARFVDIGSPEFGHCNAGQYVVLVGVRGDEIGRGKVFQVHGKWHGKSLEELSTCVVDINELKADKGMRLPYPSEATGTTFAEAESKLGVMRVLWGSNRVFALRAE

SEQ ID NO: 13129 - protein, 1017 aa, Cajanus cajan
MMSDVVIRSMLKNGGDYGGEDLGVLRERELARLRSGSAPPTVEGSLSAVGGLFEGSAAAGVFGGGRGFGSEEELRADPNYANYYYANVNLNPRFPPPLASKEDWRFVQRLRGGSKVGGIEDRGMVRDDGGIVGGDSSLFSVHPGGFGVKEEGGLKHRKGGPEWGGEDGLIGLPALGMGSRQRSIAELFQDEINNASSASKHPQNLPSSNLFDDIVEKSENRFAYAHQELDALRSGGNKQGISSAQNFVGSGPQTYASALGASLSRSSTPDSQLLPRAASPCLPPIGDGRSSTDKKSSNGQNSLNAVSSNLNDHGDLASALAGMNLSTNDIIDDEKHSQSSRHNESDYTLSFKQHPYLNNPDSVPFQRHSASQPHLQVNKSSGFGLDLNQSAGYTNEQLELHKAGGISVNSHLKGPSTPTFTSRGSPHARYQNVDDISYPNYGMTGYTVNPSSPSMMASHLGSGNLPPFFENAAAASALGLNAMDSRALGRGANLGPLLAASELQNSNRLGSHAAGSTQQLPLMDPLYLQYLRSGDVASAAQIAALNESAINRECTDLLSLQKAYVESLIAPQKSHFNVPYLAKSPTLSPNSYGNPSFGMATSYPGSPLAGSVFPNSLYGSGSPMNQSERNMRLSGMRNMAGGFVGAWPSDTVGSLDENFASSLLDEFKSNKTKCFELSEIAGHVVEFSADQYGSRFIQQKLETASMEEKNMVFHEIMPQALSLMTDVFGNYVIQKFFEHGTAAQIRELADQLTDHVLTLSLQMYGCRVIQKAIEVVDMDQQTKMVTELDGHIMRCVRDQNGNHVIQKCIECVPEDAIQFIVSTFYDQVVTLSTHPYGCRVIQRVLEYCHDPKTQQIMMDEILQSVCKLAQDQYGNYVVQHVLEHGKPYERSAIIKELSGQIVQMSQQKFASNVIEKCLTFGTPTERQILVNEMLGSTYENEPLQVMMKDQFANYVVQKVLETCDDQQLELILNRIKVHLNALKKYTYGKHIVARVEKLVAAGERRISVLTLNPAQMV

SEQ ID NO: 13130 - protein, 346 aa, Glycine max
MDAQRALLDELMGAARNLTEEERKGYKEVSWDDKEVCGFYMVRFCPHDLFVNTRSDLGPCPRIHDPKLKESFEKSPRHDAYVPKFEAELSQFCEKLVMDLDRRVRRGRERLAQEVEPTPPPPLTAEKSEQLSVLEEKIKNLLEQVESLGEAGKVDEAEALMRKVETLNAEKTALTQPQNDKVLMLGQEKKMALCEICGSFLVANDAAERTQSHVTGKQHVGYGMVRDFINEFKTAKEKANEEERLAREREAEERRKQREKESERRRRSDSSDRDRHRDKDHNRERDRYRDRDSDRERSREHDVRGYRDGGRGVDYRARNGRNGGRDRYRDRSRSRSPGKHSHRRSS

SEQ ID NO: 13131 - protein, 346 aa, Cajanus cajan
MDAQRALLDELMGAARNLTEEERKGYKEVSWDDKEVCGFYMVRFCPHDLFVNTRSDLGPCPRIHDPKLKESFEKSPRHDAYVPKFEAELAQFCEKLVMDLDRRVRRGRERLAQEVEPAPPPPLTAEKSEQLSVLEEKIKNLLEQVESLGEAGKVDEAEALMRKVETLNAEKTALTQPQNDKVLILGQEKKMALCEICGSFLVANDAAERTQSHVTGKQHVGYGMVRDFINEFKTAKEKANEEERTAREREAEERRKQREKDHERRRRSDSSDRERHRDKDHNRERDRYRDRDSDRERSREHDVRGYRDGGRGVDYRMRNGRNGGRDRYRDRSRSRSPVKHGYRRSS

SEQ ID NO: 13132 - protein, 342 aa, Glycine max
MDAQRALLDELMGAARNLTEEERKGYKEVSWDDKEVCGFYMVRFCPHDLFVNTRSDLGPCPRIHDPKLKESFEKSPRHDAYVPKFEAELSQFCEKLVMDLDRRVRRGRERLAQEVEPAPPPPLTAEKSEQLSVLEEKIKNLLEQVESLGEAGKVDEAEALMRKVETLNAEKTALTQPQNDKLLMLGQEKKMALCEICGSFLVANDAAERTQSHVTGKQHVGYGMVRDFINEFKTAKEKANEEERLAREREVEERRKQREKESERRRSDSSDRDRHRDKDHNRERDRYRDRDSDRERSREHDVRGYRDGGRGMDYRVRNGGRDRYRDRSRSRSPVKHSHRRSS

SEQ ID NO: 13133 - protein, 346 aa, Arachis hypogaea
MDAQRALLDELMGSARNLTEEERKGYKEVTWDDKEVCGFYMVRFCPHDLFVNTRSDLGPCPRIHDPKLKESFENSPRHDAFVPKFEADLAQFCEKLVMDLDRRVRRGRERLAQEVEPAPAPPLTTEKSEQLSVLEEKIKNLLEQVESLGEAGKVDEAEALMRKVDALNVEKTALTQPQNDKVLMLGQEKKMALCEICGSFLVANDAAERTQSHITGKQHVGYGMVRDFISEYKAAKEKAVEEERLAREKEAEERRKQREKDHERRRRSDSSDRDRHRDKDRDRDRDRYRDRDLDRERSRELDGRGNRDGGRGMDSRLRNGRNGGRDRYRNKSRSRSPVRHNYRRHS

SEQ ID NO: 13134 - protein, 344 aa, Lotus japonicus
MDAQRALLDELMGSARNLTEEERKGFKEVSWDDKEVCGFYMVRFCPHDLFVNTRSDLGPCPRIHDQKLKESFEKSPRHDAFVPKFEAELAQFCEKLVMDLDRKVRRGRERLSQEVEPPPPPPLTAEKSEQLSVLEEKIKNLLEQVESLGEAGKVDEAEALMRKVDTLNTEKTALTQPQNEKLMQAQEKKMALCEICGSFLVANDAAERTQSHVTGKQHVGYGMVRDFISEFQTAKEKAIEEERLAREREAEERRKRKEQEYERKRRGDSSDREKHRDKDRDRERDRYRDRDSDRERSRERDVRGYRDGGRGVDSRLGNRRNGGRDRYRDRSRSRSPVKNSYRRS

SEQ ID NO: 13135 - protein, 338 aa, Lupinus angustifolius
MDAQRALLDELMGAARNLTDEERKGYKEVNWDDKEVCGSYMVRFCPHDLFVNTRSDLGPCPRIHDQKLKESFEKSPRHDAFVPKFEAELAQFCEKLVMDLDRRVKRGRERLAQEVEPAPPPPLTAEKSEQLSVLEEKIKNLLEQVESLGEAGKVDEAEALMRKVETLNAEKTALTQPQNEKLLMLAQEKKMALCEICGSFLVANDAAERTQSHITGKQHVGYGMVRDFIKEYKDAKEKATEEERLVREREAEDRRKQKEKESERRRRSDSSDRERLRDRDRERDRYRDRHSDRARSRDRDGGRGADSRMRNGRNGGRDRYRDRSRSRSPVRHSHRRHS

SEQ ID NO: 13136 - protein, 343 aa, Quercus alba
MDAQRALLDELMGAARNLTEEERKGYKEITWDDKEVCAFYMVRFCPHDLFVNTRSDLGPCPRIHDQKLKESFEQSPRHDKYVPRFEAELSQFCEKLVTDLDRRVRRGRERLAQEVEPTPPPPLSAEKSEQLSVVEEKIKNLLEQVETLGEAGKVDEAEALMRKVELLNVEKTALTQQPQTDKVLMLAQEKKMALCEICGSFLVANDAAERTQSHVTGKQHIGYGMVRDFIAEYKAAREKAREEERLAKEKEAEERKKQREKESERRRRSDSGDRDRDRDRYHDRDRDRERDRHRERDRSRDWNARGSRDGGRGVDWRLRNGREGGRDRYRDRSRSRSPVRHGH

SEQ ID NO: 13137 - protein, 342 aa, Castanea mollissima
DAQRALLDELMGAARNLTEEERKGYKEITWDDKEVCAFYMVRFCPHDLFVNTRSDLGPCPRIHDQKLKESFEQSPRHDKYVPRFEAELSQFCEKLVTDLDRRVRRGRERLAQEVEPTPPPPLSAEKSEQLSVVEEKIKNLLEQVETLGEAGKVDEAEALMRKVELLNIEKTALTQQPQTDKVLMLAQEKKMALCEICGSFLVANDAAERTQSHVTGKQHIGYGMVRDFIAQYKEAREKAREEERLAKEKEAEERKKQREKESERRRRSDSGDRDRDRDRYHDRDRDRERDRHRERDRSRDWNARGSRDGGRGVDWRLRNGREGGRDRYRDRSRSRSPIRHGH

SEQ ID NO: 13138 - protein, 344 aa, Cicer arietinum
MDAQRALLDELMGSARNLTEEERRGYKEVSWDDKEVCGFYMVRFCPHDLFVNTRSDLGPCPKIHDPKLKESFEKSPRHDAYVPKFEAELAQFCEKLVMDLDRRVKRGRERLNQEVELPPPPPLTAEKSEQLSVLEEKIKNLLEQVESLGEAGKVDEAEALMRKVETLNTEKAALTQPQNDKVLMLQEKKMALCEVCGSFLVANDAAERTQSHVAGKQHVGYGMVRDFINEYKAAKEKAIEEERLARDRDTEEGRKQREKDDGRKRRSDSSDREKYRDKDRDRERDRYRGRDSDRERSREYEVRGNRDRVRGMDSRLRNGKNGGRDRYRNRSRSYSPVRHNHRRS

SEQ ID NO: 13139 - protein, 354 aa, Prunus persica
MDAQRALLDELMGAARNLTEEERKGYKEITWDDKEVCGAYMVRFCPHDLFINTRSDLGPCPKIHDPKLKESFEESPRHDAYVPKFEAELAQFCEKLVMDLDRRVKRGRERLAQEVEPAPAPPLSAEKSEQLSVLEEKIKNLLEQVETLGEAGKVDEAEALMRKVDMLNSEKTALAQHPQNDKVLMLAQEKKMALCEICGSFLVANDALERTQSHVTGKQHIGYGMVRDFITEYKETKEKAREEERLAREKEAEERRKQREKENESRRRSNSSDRDRYRDRDRDRERDRYRERDSDRERSREWNGRGSRDGGRGADWRSRNGRDGGRDRYRDRSRSRSPVRHSHRRSPRSPVRPY

SEQ ID NO: 13140 - protein, 344 aa, Trigonella foenum-graecum
MDAQRALLDELMGSARNLTEEERRGYKEVSWDDKEVCGFYMVRFCPHDLFVNTRSDLGACPKIHDPKLKENFENSPRHDAYVPKFEADLAQFCEKLVMDLDRRVKRGRERLNQEVELPPPPPLTAEKSELLSVLEEKIKNLLEQVESLGEAGKVDEAEALMRKVETLNTEKAVLTQPQNEKVLLLQEKKMALCEVCGSFLVANDAAERTQSHVAGKQHVGYGMVRDFINEYKTAKEKAKEEERLTREKEVEERRKQKEKDTERKRRSDSSDRDKYRDKDRDRERVRYRDRDSDRERSREYEVRGNRDRGRGVDSRLRNGNNGSRDRYHNRSRSRSPVKHNYRRS

SEQ ID NO: 13141 - protein, 354 aa, Prunus mume
MDAQRALLDELMGAARNLTEEERKGYKEITWDDKEVCGAYMVRFCPHDLFINTRSDLGPCPKIHDPKLKESFEESPRHDAYVPKFEAELAQFCEKLVMDLDRRVKRGRERLAQEVEPAPAPPLSAEKSEQLSVLEEKIKNLLEQVETLGEAGKVDEAEALMRKVDMLNSEKTALAQHPQNDKVLMLAQEKKMALCEICGSFLVANDALERTQSHVTGKQHIGYGMVRDFIAEYKETKEKAREEERLAREKEAEERRKQREKENESRRRSNSSDRDRYRDRDRDRERDRYRERDSDRERSREWNGRGSRDGGRGADWRSRNGRDVGRDRYRDRSRSRSPVRHSHRRSPRSPVRPY

SEQ ID NO: 13142 - protein, 344 aa, Malus domestica
MDAQRALLDELMGSARNLTEEERRGYKEITWDDKEVCGAYMVRFCPHDLFVNTRSDLGPCPKLHDPKLKESFEESPRHDAYVPKFEAELAHFCEKLVMDLDRRVKRGRERLAQEVEPAPAPPLSAEKSEQLSVLEEKIKNLLEQAEALGEAGKVDEAEALMRKVDMLNSEKTALAQPQNDKVLMLAQEKKMALCEICGSFLVANDAVERTQSHVTGKQHIGYGMVRDFIAEFKESKEKAREEERLAREKEAEERRKQREKEEENRRRSNSSDRDRYRDRDRDRERDRYRERDLDRERSREWNGRSSRDGGRGVDRRSRNGRDGGRDRYHDRSRSRSPVRHSHRR

SEQ ID NO: 13143 - protein, 358 aa, Vitis vinifera
MDAQRALLDELMGAARNLTEEEKKGYKEVTWDDKEVCGFYMVRFCPHDLFVNTRSDLGPCPRIHDQKLKESFEKSPRHDSYVPRFEAELSQFCEKLVMDLDRRVRRGRERLAQEVEAAPPAPLSLEKSEQLSVLEEKIKNLLEQVEALGEAGKVDEAEALMRKVEMLNAEKTVLTQQPQNDKVLMLAQEKKMALCETCGSFLVANDAAERTQSHVTGKQHIGYGMVRDFITEYKEAKEKAREEERLKREKEAEERRKQREKESESRSRRADSGDRDRTRDRDRDRERDRYRERERDRERPREWNGRGYRDGGRGTDWRYSNSRDGRDGGRDRYRDRSRSRSPVRHSHRRSPQSPVRPY

SEQ ID NO: 13144 - protein, 389 aa, Malus domestica
MDAQRALLDELMGSARNLTEEERKGYKEITWDDKEVCKAYMVRFCPHDLFVNTRSDLGPCSKIHDPKLKESFEESPQHDAYVPKFEAELAHFCEKLVMDLDRRVKRGRERLAQEVEPAPAPPLSAEKSEQLSVLEEKIKNLLEQVEALGEAGKVDEAEALMRKVDMLNSEKTALDQQPQNDKVLMLAQEKKMALCEICGSFLVANDAVERTQSHVTGKQHIGYGMVRDFIAEFKESKEKAREEERLAREKEAEERRKQREKEQEDRRRSNSSDRDRYRDRDRDRERDRYRERDSDHERSREWNGRGSRDGARGVDHRSRNGRDGGRDRYRDRSRSRSPVRHSHKSFGVQISVSVSEEPLLSRTVVSMGMDIYFTRLGCDIRFAVNGEWR

SEQ ID NO: 13145 - protein, 370 aa, Panax ginseng
MDAQRALLDELMGAARNLTEEERKGYKEVTWDDKEVCGFYMVRFCPHDLFVNTRSDLGPCPKIHDQKLKDSFESSPRHESYVPKFEADLAHFCEKLVMDLDRRVRRGRERLDQEVEVPPPPPVPVEKSEQLSVLEEKIKNLLEQVEALGEAGKVDEAEALMRKVDVLNAEKTALTQQPQNDKVLMLAQEKKMALCETCGSFLVANDAIERTQSHVTGKQHIGYGMVRDFLAEYKEAKEKAREEERLAREKETEERRKQREKEYESRRRRSDSGDRDRNRDRIRTKSGTGTESGTEIVKGLGREMVEEAVTGEEGWIGSITILEMEEREAEIDTVSVIGAGRVPLLSVDAGGHPEVQFAHITELCRYMSEF

SEQ ID NO: 13146 - protein, 77 aa, Cucurbita pepo
MDAQRALLDELMGSARNLTEEERRGYKEVMWDDKEVCGFYMVRFCPHDLFVNTRSDLGPCPRIHDQRLKKALKVTQA

SEQ ID NO: 13147 - protein, 335 aa, Lupinus angustifolius
MDAQRALLDELMGAARNLTDEERKVYKEVNWDDKDVCGFYMVRFCPHDLFVNTRSDLGTCPRIHDQKLKESFEKSPRHDAFVPKFEAELAQFCEKLVMELDRRVKRGRERLAQEVEPAPPPPLTAEKSEQLSVLEEKIKNLLEQVESLGEAGKVDEAEALMRKVEILNAEKTGLTQPQNEKVLMLAQEKKMALCEICGSFLVENDALERTQSHITGKQHVGYGMVRDFIKEYKDAKEKATEEERLAREREAEDRRIQREKSERSRRGDSSDRERHRDRDRERDRHRDKGSDRERSRDRNGGRWVDSRMRNGRNGGRDGYRDRRRSRSPARHSQRR

SEQ ID NO: 13148 - protein, 344 aa, Medicago truncatula
MDAQRALLDELMGSARNMTEEERRGYKEVSWDDKEVCGFYMVRFCPHDLFVNTRSDLGACPKVHDPKLKENFENSPRHDAYVPKFEADLAQFCEKLVMDLDRRVKRGRERLNQEVELPPPPPLTAEKSEQLSVLEEKIKNLLEQVESLGEAGKVDEAEALMRKVETLNTEKAVLTQPQNEKVLMLQEKKMALCEVCGSFLVANDAAERTQSHVAGKQHVGYGMVRDFINEHKIAKEKAKEEERLTREKEVEERRKQKEQDPERKRRSDSSDREKYRDKDRDRQRDRYRDKDSERERSREYEGRGNRDRGRGMVFRLRNEKNGSRDRYHNRSRSRSPIKHNYRRS

SEQ ID NO: 13149 - protein, 361 aa, Amsonia hubrichtii
MGAARNLTEEERKGYREVTWDSKEVCSFYMVRFCPHDLFVNTRSDLGPCPKIHDPKLKESFEASPRHDAYVPKFEAELAHFCEKLVMDLDRRVRRGRERLAQEVEVPPPPPISAEKSEQLSVLEEKIKNLLEQVESLGESGKVDEAEALMRKVEMLNVEKTVLTQQPQQDKVLMMAQEKKMALCEICGSFLVANDAAERTQSHITGKQHMGYGMVRDFLSEYKVAKEKAREEERLAREKEAEERKKQREKEYESRRRRSESADRDKHRSRDHDRERDRYRERDGDRERSRDRNGRGSRDGGRGSDWRHSSSRNGRDRSRDRYRERERADHVLPLGMVTGSHPGVQFAHIEHCVDRCLKFEI

SEQ ID NO: 13150 - protein, 319 aa, Catharanthus roseus
MVRFCPHDLFVNTRSDLGACPKIHDPKLKESFEASPRHDAYVPKFEAELAHFCEKLVMDLDRRVRRGRERLAQEVEVPPPPPISAEKSEQLSVLEEKIKNLLEQAESLGESGKVDEAEALMRKVEMLNAEKTALTQQPQQDKVLMIAQEKKMALCEICGSFLVANDAAERTQSHITGKQHMGYGMVRDFLTEYKAAKEKAREDERLAREKEAEERKKLKEKESESRRRRSDSADRDRHRSRDHDRERDRYRNRDGDHERSRDRNGRGSRDGSGSDWRHSSSRNGRPRSRDRYRERERSRSRSPIRHGNRRSSRSPVRPY

SEQ ID NO: 13151 - protein, 358 aa, Vitis vinifera
MDAQRALLDELMGAARNLTEEEKKGYKEVTWDDKEVCGFYMVRFCPHDLFVNTRSDLGPCPRIHDQKLKESFEKSPRHDSYVPRFEAELAQFCEKLVMDLDRRVRRGRERLAQEVEAAPPAPLSLEKSEQLSVLEEKIKNLLEQVEALGEAGKVDEAEALMRKVEMLNAEKTVLTQQPQNDKVLMLAQEKKMALCETCGSFLVANDAAERTQSHVTGKQHIGYGMVRDFITEYKEAKEKAREEERLKREKEAEERRKQREKESESRSRRADSGDRDRTRDRDRDRERDRYRERERDRERPREWNGRGYRDGGRGTDWRYSNSRDGRDGGRDRYRDRSRSRSPLVYQSVRLKLMRLNLG

SEQ ID NO: 13152 - protein, 344 aa, Medicago truncatula
MDAQRALLDELMGSARNMTEEERRGYKEVSWDDKEVCGFYMVRFCPHDLFVNTRSDLGACPKVHDPKLKENFENSPRHDAYVPKFEADLAQFCEKLVMDLDRRVKRGRERLNQEVELPPPPPLTAEKSEQLSVLEEKIKNLLEQVESLGEAGKVDEAEALMRKVETLNTEKAVLTQPQNEKVLMLQEKKMALCEVCGSFLVANDAAERTQSHVAGKQHVGYGMVRDFINEHKIAKEKAKEEERLTREKEVEERRKQKEQDPERKRRSDSSDREKYRDKDRDRQRDRYRDKDSDRERSREYEGRGNRDRGRGMVSRLRNEKNGSRDRYHNRSRSRSPIKHNYRRS

SEQ ID NO: 13153 - protein, 348 aa, Citrullus lanatus
MDAQRALLDELMGSARNLTEEERRGYKEVMWDDKEVCGFYMVRFCPHDLFVNTRSDLGPCPRIHDQKLKESFEKSPRHDAYVPKFEAELAQFCEKLVMDLDRRVRRGRERLAQEVEPAPPTPLSAEKSEQLSVLEEKIKNLLEQVEALGEAGKVDEAEALMRKVDSLNTEKTSLTQQTQNDKVLMLAQEKKMALCEICGSFLVANDAAERVQSHVTGKQHVGYGMVRDFISEHKEAKEKAREEERLAREKEAEERRKQREEFERRKRSDSSEKDKYRDRERDRDRDRYRERDRDRERSRRGGRDEIRGMDWRSRNGRDGGRDRYRDRSRSKSPVRRGHRRSSRSPVRS

SEQ ID NO: 13154 - protein, 351 aa, Theobroma cacao
MDAQRALLDELMGTARNLTEEEKKGYREIRWDDKEVCGFYMVRFCPHDLFVNTRSDLGPCPRVHDQKLKESFEKSPRHDAYVPKFEAELAQFCEKLVMDLDRRVRRGRERLAQEVEPAPPAPVSAEKSEQLSVLEEKIKNLLEQVENLGESGKVDEAEALMRKVEVLNAEKTALTQQPQNDKVLMLAQEKKMALCEVCGSFLVANDAAERTQSHVTGKQHIGYGMVRDFISEFKAAKEKAREEERLAREKEVEERRKQREKEYESRRRRSDSDDRDKYRDRDKDRDRYRERDLERERSREWNGRGSRDGERDWRYKNGRDGGRDRHKDRSRSRSPGRHSHRRSSRSPGRRY

SEQ ID NO: 13155 - protein, 351 aa, Theobroma cacao
MDAQRALLDELMGTARNLTEEEKKGYREIRWDDKEVCGFYMVRFCPHDLFVNTRSDLGPCPRVHDQKLKESFEKSPRHDAYVPKFEAELAQFCEKLVMDLDRRVRRGRERLAQEVEPAPPAPVSAEKSEQLSVLEEKIKNLLEQVENLGESGKVDEAEALMRKVEVLNAEKTALTQQPQNDKVLMLAQEKKMALCEVCGSFLVANDAAERTQSHVTGKQHIGYGMVRDFISEFKAAKEKAREEERLAREKEVEERRKQREKEYESRRRRSDSDDRDKYRDRDKDRDRYRERDLERERSREWNGRGSRDGERDWRYKNGRDGGRDRHKDRSRSRSPGRHSHRRSSRSPGQRY

SEQ ID NO: 13156 - protein, 347 aa, Cucumis sativus
MDAQRALLDELMGSARNLTEEERRGYKEVMWDDKEVCGFYMVRFCPHDLFVNTRSDLGPCTRIHDQKLKESFEKSPRHDAYVPKFEAELAQFCEKLVMDLDRRVRRGRERLAQEVEPAPPTPLSAEKSEQLSVLEEKIKNLLEQVEALGEAGKVDEAEALMRKVDLLNTEKTALTQQTQNDKVLMLAQEKKMALCEICGSFLVANDAAERVQSHVTGKQHVGYGMVRDFISEHKEAKEKAREEERLAREKEAEERKKQREEFERRKRGDSSEDKYRDRERDRDRNRYRERDRDRERSRRGGRDEIRGMDWRSRNGRDGGRDRYRDRSRSKSPIRRGHRRSSRSPLRP

SEQ ID NO: 13157 - protein, 361 aa, Panax ginseng
MDAQRALLDELMGAARNLTEEERKGYKEVTWDDKEVCGFYMVRFCPHDLFVNTRSDLGPCPKIHDQKLKDSFESSPRHDSYVPKFEADLAHFCEKLVMDLDRRVRRGRERLDQEVEVPPPPPVPVEKSEQLSVLEEKIKNLLEQVEALGEAGKVDEAEALMRKVDVLNAEKTALTQQPQNDKILMLAQEKKMALCETCGSFLVANDAIERTQSHVTGKQHIGYGMVRDFLAEYKEAKEKAREEERLAREKETEERRKQREKEYESRRRRSDSGDRDRNRDRDQDQERDRYRERDRDRERSRERNGRGSRDGGRGLDWKYNNSRNGREGSRDRYRERDRSRSRSPVKRGRRRSSRSPVRSYY

SEQ ID NO: 13158 - protein, 304 aa, Coffea canephora
MDAQRALLDELMGAARNLTEEERKGYKEITWDSKEVCSSYMVRFCPHDLFVNTRSDLGPCPKIHDQKLKESFEKSPRHDAYVPKFEAELAHFCEKLVMDLDRRVRRGRERLAQEIDVPPPPPIPAEKSEQLAVLEEKIKNLLEQVESLGEAGKVDEAEALMRKVEVLNAEKTALTQQPQQDKVLMMAQEKKMALCEICGSFLVANDAAERTQSHVTGKQHMGYGMVRDYLAEYKEAKEKKREEERLAREKEAEERRKQREKEYESRHRRSESSERDRYRDRDHNRERDRYRERDGDRERFSRGE

SEQ ID NO: 13159 - protein, 348 aa, Gossypium raimondii
MDAQRALLDELMGTARNLTDEEKKGYREIRWDDKEVCAFYMVRFCPHDLFVNTRSDLGPCPRVHDQKLKESFEKSPRHDAYVPKFEAELAQFCEKLVMDLDRRVRRGRERLAQEVEPAPPAPLSAEKSEQLSVMEEKIKNLLEQVETLGEAGKVDEAEALMRKVEALNAEKTALAQQPQNDKVLMLAQEKKMALCEVCGSFLVANDAAERTQSHVTGKQHIGYGMVRDFISEFNEAKEKAREEEKLSREKEAEERRKQREKEYESRRRSDSGDRDKYHDRDKDRDRYCERDLYRERSREWNGRGIHDGERDWRYRNGRDGGRDRHRKRSRSRSPSRHSRRRSSRSPVH

SEQ ID NO: 13160 - protein, 345 aa, Unknown
  Sequence found in Organisms: Citrus clementina, Citrus sinensis
MDAQRALLDELMGAARNLTEEEKKEYKEIKWDDKEVCPFYMVRFCPHDLFVNTRSDLGPCPRIHDQKLKESFEKSPRHDAYVPKFEAELAQFCEKLVMDLDRRVRRGRERLSQEVEPAPPPPISAEKSEQLSVLEEKIKNLLEQVETLGEAGKVDEAEALMRKVEILNVEKTTLTQQSQNDKVLMMAQEKKMALCEICGSFLVANDAAERTQSHISGKQHIGYGMVRDFITEYKEAKEKAREEERLAKEKEVEDRRKQREKEYESRKRSGSSDRDRYRDRDRDRERERYRERDRERSREWDGRSGRDGGRGADWRSRDRHRDRSRSRSPVRHGHRRSPRSPVRQY

SEQ ID NO: 13161 - protein, 350 aa, Gossypium raimondii
MDAQRALLDELMGTARNLTDEEKKGYREIRWDDKEVCAFYMVRFCPHDLFVNTRSDLGPCPRVHDQKLKESFEKSPRHDAYVPKFEAELAQFCEKLVMDLDRRVRRGRERLAQEVEPAPPAPLSAEKSEQLSVMEEKIKNLLEQVETLGEAGKVDEAEALMRKVEALNAEKTALAQQPQNDKVLMLAQEKKMALCEVCGSFLVANDAAERTQSHVTGKQHIGYGMVRDFISEFKEAKEKAREEEKLSREKEAEERRKQREKEYESRRRSDSGDRDKYHDRDKDRDRYCERDLDRERSRERNGRGIRDGERDWRYRNGRDGGRDRHRKRSRSHSPSRHSRRRSSRSPVHRY

SEQ ID NO: 13162 - protein, 348 aa, Fragaria vesca
MDAQRALLDELMGAARNLTEEERKGYKEVTWDSKEVCGAYMVRFCPHDLFVNTRSDLGPCPKIHDSKLKESFEKSPRHDAYVPRFEADLAQFCDKLVMDLDRRVKRGRERLSQEVEPPPPPPLSAEKAEQLSVLEEKIKNLLEQVEELGASGKVDEAEALMRKVDVLNVEKTVLALQPPNAQALMVPQEKKMALCEICGSFLVANDALERTQSHVTGKQHIGYGMVRDFISEYKAAKEKAREEEKLAREKEAEERRKQQEKESESRRRSGSSDRDRYRDHDRYRERDLDRERSREWNGRGGQDGGRGVDWRSRNGRDGGRDRYRNRSRSRSPIRRSHRRSPRSPVRPY

SEQ ID NO: 13163 - protein, 352 aa, Cannabis sativa
MDAQRALLDELMGAARNMTDEERKGFKEVTWDDKEVCGAYMVRFCPHDLFVNTRSDLGPCPRIHDPKLKESFEKSPRHDAFVPKFETELAQFCEKLVMDLDRRVRRGRERLAQEVEPAPAQPLSSEKAEQLSQLEDKIKNLLEQVESLGEAGKVDEAEALMRKVDTLNTEKAALTQQTLPDKVLLLAQEKKMALCEICGSFLVANDAVERTQSHITGKQHIGYGMVRDFISEYKLAKEKGREEERLAREKETEERRKQREKELDSRRRSVSGDRDRHRDRERERDRYRDRDLDRERSRDWNGRGNRDGGRSGEWRSRNGRDGARDRNRDRSRSRSPVRHGHRRSPRSPVHPY

SEQ ID NO: 13164 - protein, 137 aa, Panax ginseng
MDAQRALLDELMGAARNLTEEERKGYKEVTWDDKEVCGFYMVRFCPHDLFVNTRSDLGPCPKIHDQKLKESFESSPRHASYVPKFEADLVHFCEKLVMDLDRRVRRGRERLDQEVEVPPETPVTVEKSEQLSVLEEK

SEQ ID NO: 13165 - protein, 352 aa, Cannabis sativa
MDAQRALLDELMGAARNMTDEERKGFKEVTWDDKEVCGAYMVRFCPHDLFVNTRSDLGPCPRIHDPKLKESFEKSPRHDVFVPKFETELAQFCEKLVMDLDRRVRRGRERLAQEVEPAPAQPLSSEKAEQLSQLEDKIKNLLEQVESLGEAGKVDEAEALMRKVDTLNTEKAALTQQTLPDKVLLLAQEKKMALCEICGSFLVANDAVERTQSHITGKQHIGYGMVRDFISEYKLAKEKGREEERLAREKETEERRKQREKELDSRRRSVSGDRDRHRDRERERDRYRDRDLDRERSRDWNGRGNRDGGRSGEWRSRNGRDGARDRNRDRSRSRSPVRHGHRRSPRSPIHPY

SEQ ID NO: 13166 - protein, 351 aa, Unknown
  Sequence found in Organisms: Gossypium hirsutum, Gossypium raimondii
MDAQRALLDELMGTARNLTEEEKKGYRELRWDDKEVCAFYMVRFCPHDLFVNTRSDLGQCPRVHDPKLKESFEKSSRHDAYVPKFEAELAKFCEKLVMDLDRRVRRGRERLAQEVEPAPPAPLSAEKSEQLSVLEEKIKNLLEQVESLGEAGKVDEAEALMRKVEALNAEKTVLTQQPQNDKVLMLAQEKKMALCEVCGSFLVANDAAERTQSHVTGKQHIGYGMVRDFISEFKEAKEKAREEEKLAREKEAEERRKQKEKEYESRRSRSDSGDRDKYRDRDKDSDRYRDRDLDRERSQEWSGRGSRDGEREWRYKNGRDGGRDRHHNRSRSRSPGRHSHRRSSRSPVRRY

SEQ ID NO: 13167 - protein, 350 aa, Gossypium hirsutum
MDAQRALLDELMGTARNLTDEEKKGYREIRWDDKEVCAFYMVRFCPHDLFVNTRSDLGPCPRVHDQKLKESFEKSPRHDAYVPKFEAELAQFCEKLVMDLDRRVRRGRERLAQEVEPAPPAPLSAEKSEQLSVMEEKIKNLLEQVETLGEAGKVDEAEALMRKVEALNAEKTALAQQPQNDKVLMLAQEKKMALCEVCGSFLVANDAAERTQSHVTGKQHIGYGLVRDFISEFKEAKEKAREEEKLSREKEAEERRKQREKEYESRRRSDSGDRDKYHDREKDRDRYWERDLDRERSRERNGRGIRDGERDWRYRNGRDGGRDRHRKRSRSHSPSRHSRRRSSRSPVHRY

SEQ ID NO: 13168 - protein, 357 aa, Panax ginseng
MDAQRALLDELMGAARNLTEEERKGYKEVTWDDKEVCGFYMVRFCPHDLFVNTRSDLGPCPKIHDQKLKDSFESSPRHESYVPKFEADLAHFCEKLVMDLDRRVRRGRERLDQEVEVPPPPPVPVEKSEQLSVLEEKIKNLLEQVEALGEAGKVDEAEALMRKVDVLNAEKTALTQQPQNDKILMLAQEKKMALCETCGSFLVANDAIERTQSHVTGKQHIGYGMVRDFLAEYKEAKEKAREEERLAREKETEERRKQREKEYESRRRRSDSGDRDRNRDRDQDQERDRYRERERSRERNGRGSRDGGRGLDWKYNNSRNGREGSRDRYRERDRSRSCSPVRRGRRRSSRSPVRSYY

SEQ ID NO: 13169 - protein, 357 aa, Panax ginseng
MDAQRALLDELMGAARNLTEEERKGYKEVTWDDKEVCGFYMVRFCPHDLFVNTRSDLGPCPKIHDQKLKDSFENSPRHDSYVPKFEADLAHFCEKLVMDLDRRVRRGRERLDQEVEVPPPPPVPVEKSEQLSVLEEKIKNLLEQVEALGEAGKVDEAEALMRKVDVLNAEKTALTQQPQNDKILMLAQEKKMALCETCGSFLVANDAIERTQSHVTGKQHIGYGMVRDFLAEYKEAKEKAREEERLAREKETEERRKQREKEYESRRRRSDSGDRDRNRDRDQDQERDRYREQERSRERNGRGSRDGGRGLDWKYNNSRNGREGSRDRYRERDRSRSCSPVRRGRRRSSRSPVRSYY

SEQ ID NO: 13170 - protein, 351 aa, Gossypium raimondii
MDAQRALLDELMGTARNLTEEEKKGYRELRWDDKEVCAFYMVRFCPHDLFVNTRSDLGLCPRVHDPKLKESFEKSSRHDAYVPKFEAELAKFCEKLVMDLDRRVRRGRERLAQEVEPAPPAPLSAEKSEQLSVLEEKIKNLLEQVESLGEAGKVDEAEALMRKVEALNAEKTVLTQQPQNDKVLMLAQEKKMALCEVCGSFLVANDAAERTQSHVTGKQHIGYGMVRDFISEFKEAKEKAREEEKLAREKEAEERRKQKEKEYESRRSRSDSGDRDKYRDRDKDSDRYRDRDLDRERSQEWSGRGSRDGEREWRYKNGRDGGRGRHHNRSRSRSPGRHSHRRSSRSPVRRY

SEQ ID NO: 13171 - protein, 341 aa, Tropaeolum majus
MDAQRALLDELMGSARNLTEEERKGYKEIRWDDKEVCVFYMVRFCPHDLFVNTRSDLGPCPRIHDLKLKESFENSPRHDSYVPKFEAELAQFCEKLVMDLDRRVRRGRERLAQEVEPAPPAPLSAEKVEQLSVLEEKIKNLLEQVETLGEAGKVDEAEALMRKVEALNVEKTLIQQPQNDKVLMLAQEKKMALCEICGSFLVANDAAERTQSHVTGKQHVGYGLVRDYIAEYKEAKEKTREEERLAREKEAEERRKQREKEYESRSNSRDRDQDSDRYRERDRNRETSRDWNSRSNRDGGRDWRSRNGRDSGRDRYRNRSKSRSPGRHGHRRMSRSPVRQY

SEQ ID NO: 13172 - protein, 336 aa, Vigna unguiculata
MHRSVVQSSPVQQMMAGNPNWWNININTMPPQQPSPFFSSPSNFPIPYAAPSSLPFPSWNENQDLPESWSQLLMSGVVDEQGKVGMGQFQTKKMENWEDQMLGQAQNASLVDVKQENSVNSYVYGHGNEELQSSKPSWSPKSSCATSFSSNMLDFSNSNTDARHPPPDRSSECNSSAGGGALKKARVQPSATTQATFKVRKEKLGDRITALHQLVSPFGKTDTASVLLEAIGYIRFLQSQIEALSLPYLSGGPGSGRQQNSVQGEKNCIFPEDPGQLLNNENSLKRKAAGEPETEEEQKKGLRSRGLCLVPVSCTLQVGSDNGADYWAPALGGGFR

SEQ ID NO: 13173 - protein, 334 aa, Glycine max
MNRGVLQSSPVQQMMTGNPNWWNININSMAPQAPPFLSTPNNFPIPCAPTSLPFPSWHENQDLPESWSQLLMSGVVDEQGKAGMGQFIQTKKLESWEDQMLGQAPNASLVDVKQENLVNSYAYGHGSEELQSSKPSWSPKSCVTTSFSSNMLDFSNNKTDARHPPPDLSSECNSTAAGGALKKARVQPSATTQTTFKVRKEKLGERITALHQLVSPFGKTDTASVLLEAIGYIRFLQSQIEALSLPYLSGGSGNTRQQHSVQGEKTCIFPEDPGQLLDENCLKRKAAGEPDTQEEPKKGLRSRGLCLVPVSCTLQVGSDNGADYWAPALGGGFR

SEQ ID NO: 13174 - protein, 335 aa, Cajanus cajan
MNRGVLQSSPVQQMMTGNPNLWNININNMPPQAPPFLSTPSNFPIPYAPTSSSFPFPWHENQELPESWSQLLMSGMVDAEDKAVMGQFHTKKLENWEDQMLISQASNASLIEVKQEDSVNSYVYGHRNEELQSSTPSWSPKSCVTSYSSNMLDFSNNKTDARHPPPDRSYECNSSGAGGALKKARVQPSATTQSTFKVRKEKLGDRITALHQLVSPFGKTDTASVLFEAIAYIGFLHSQIEVLSSPYLRGGSGNTGQQQHSVQGEKNCIFPEDPGQLLNENCLKRKAAGEPDTQEEPENSLRSRGLCLVPVSCTLQVGRENGADYWAPPLGGGFR

SEQ ID NO: 13175 - protein, 206 aa, Vigna unguiculata
MDANGESERGKGSVSLEGEKVILVPYMEAHVPKYHQWMKDPSLLQATASDPLTLQQEYQMQLSWIQDPFKETFIVLDKDLVVGQFSHGEPHLEAMVGDVNLFMNDLDDPHVAEVEIMIAEPKSRRKGLGKESVLMMMTFAIEKLGINTFRTKIGDSNGASLDMFKKLGFVQTSYSSIFKEVTLELQMTQPKKEDMLGLMKMVIKHT

SEQ ID NO: 13176 - protein, 199 aa, Glycine max
MGEKGCVSLEGKKVILVPYMEAHVPKYHEWMKDPSLLQATGSEPLTLQQEYTMQLSWSQDPNKETFIVLDKDLVVGDFSHGEPHPEAMVGDVNIFMNDLDDPHVAEIEIMIAEPKSRRKGLAKESVLMMMTFAIEKLGINIFRVKIGESNGASLDLFQKLGFVQTSYSSIFKEVTLELQITQPKKEAMLGLIGTVIKHT

SEQ ID NO: 13177 - protein, 203 aa, Cajanus cajan
MGERRNGKGSVSLEGEKVILVPYMEAHVPKYHEWMKDPSLLQATASEPLTLQQEYHMQLSWSQDPNKETFIVLDKDLVLGDFSHGEPHLEAMVGDVNIFMNDLDNPHVAEVEIMIAEPKSRRKGLAKESVLMMMTFAIKKLGITSFQVKIGDSNGASLDLFQKLGFVETSYSSIFKEVTLELQITQPKKEEMLGLMGTVIKHT

SEQ ID NO: 13178 - protein, 519 aa, Glycine max
MASIHANLVPNLSFNHFQTPPSSYLVGAGIVQRGVSLRNCRRKVPCIIKCEKKDDEVEHIQNVSVERPPYYSYLDSTSGQLEPASGARASIPGQEYWPEGTASRVRAARAPAPTAESSTSPSYGTKPGSRRKNYKTTVPAAAASSQPIVESNGTGSGGSSEVLIESLEESQDDVSDFVVYQSEPEEEELSEYEFDKKLGLPHPFIDPKVNKPIEGTLSNDELWWNWRQPEKEQWSRWQRRKPDVETVFLNAMAETGQIKLHGEHPTLTETALYRARREIYKEERLQAEQERLERDGPIAYYSEWVKAWKRDTSREAIQKHFEETGEDETTQLIEMFCHQTDREYRIMMGTDVRIQRDPLAMRMREDQIKQIWGGDPVYPTVNYIQDPNEVIDYRGPDFHEPTPNMVSYLKEKGKLISREEFDKIMAKEKTEQIESTEMDEAMAKAVDIGENDDEEDSDVDGEEEGEEEKLSDYWSVLKSTPELRQSKPKPKKEGPLSLDEVIEESENLTDFLMDFEEEE

SEQ ID NO: 13179 - protein, 518 aa, Cajanus cajan
MASIHSNFLPNLSFNHFQTPSSYLVGAGILQRGVSLSSCRKRVPSYSCIKCEKKDDEHIEHVSVERPPYYSYMDSTSGQLEPASGARASIPSQEYWPEGTASRVRAARAPAPTAESSTSPSYGAKPGSRRKNYKTSVHAAAAAASSQPVVESTASGSTEVLVDSVEDSQDDLSDFVVYQSEPEEEVLSEYEMDKRLGLPHPFVDPKVNKPIEGTLSNDELWWNWRQPEKEQWSRWQRRKPDVETVFLKAMAETGQIKLHGEHPTLAETALYRARREIYKEERLQAEQDRLERDGPIAYYSEWVKAWKRDTSREAIQKYFEETGEDENAQLIEMFCHQTDREYRIMMGTDLRIQRDPLAMRMREDQIKQIWGGDPVYPTVNYIQDPNEVIDYRGADFHEPTPNMVAYLKEQGKLISREEFDKIMAKEKTEQIEMTDMDDAMAKAVDIGENDDEEDSDLDEGEEEVEEEKLSDYWSVLKSTPELRKSKPKPKKDGSLSLDDAIEDSENLTDFLMDFEEEE

SEQ ID NO: 13180 - protein, 165 aa, Ambrosia trifida
MVRNSFFPSFFYPKTGMNTRATYSLNEDGTVHVLNETWNDGKRSSIEGSAYKADPNSDEAKLKVKFYVPPFLPIIPVVGNYWVLYLDDDYQYALIGEPTRKNLWILCRNTHIDEEVYNQLIEKAKEEGYDVSKLKKTTQTDPPPESEDGPKDTKGIWWIKSIFGK

SEQ ID NO: 13181 - protein, 185 aa, Humulus lupulus
MANKEMEVVKGLDIERYMGRWYEIASFPSFFQPRSGVDTRATYTLNEDGTVHVLNETWSDGKRGSIEGTAYKADPKSDEAKLKVKFYVPPFLPIIPVTGDYWVLYIDEDYQVALIGQPTRKYLWILARKTHIDDEIYNQLVEKAKAEGYDVSKLHKTPQSDSPPEGDEGPKDTKGIWWIKSLFGK

SEQ ID NO: 13182 - protein, 185 aa, Cajanus cajan
MAENELKVVRGLDLQRYTGRWYEIASFPSFFQPRNGENTRATYTLNEDGTVHVLNETWSNGKRVSIEGSAYKADPKSDEAKLKVKFYVPPFLPIIPVVGNYWVLYVDDDYQYALIGEPTRKYLWILCRKTHLEDEIYNQLLEKATTEKYDVSKLHKTPQSDPPPEGDEGPKDNKGIWWIKSLFGK

SEQ ID NO: 13183 - protein, 185 aa, Platanus occidentalis
MAKKEMEVVKGIDLQKYMGRWYEIASFPSMFQPKNGINTRATYTLREDGTVHVLNETWSDGKRGSIEGTANKANPSSDEAKLKVKFYVPPFLPIIPVVGDYWVLYLDDDYQYALVGQPSRKYLWILCRQTHLDEEIYNQLVQKATEEGYDVKKLHKTPQTDPPPEGEEGPKDTKGIWWIKSIFGK

SEQ ID NO: 13184 - protein, 186 aa, Cannabis sativa
MANNKEMRVVKGLDVERYMGRWYEIASFPSFFQPRDGANTRATYTLKEDKATVHVLNETWSGGKRDSIEGIAYKADPKSDEAKLKVKFYVPPFLPIIPVVGNYWVLYVDPDYQVALVGEPTRKSLWILARKTHIDDEIYNLVVEKAKEEGYDVTKLHKTPQSDPPPEGEGPNDNKGIWWIKSLFGK

SEQ ID NO: 13185 - protein, 185 aa, Carpinus betulus
MANKEMEVVKGVDLKRYMGRWYEIASFPSRFQPKNGENTRATYTLRDDGIVNVLNETWNDGKRGYIEGTAYKADPNSDEAKLKVKFYVPPFLPIIPVVGDYWVLFLDDDYQYALIGEPSRKYLWVLCRQTHLDDEIYNQLVERAKEKGYDVSKLHKTPQSDPPPEGEEGPKDTKGIWWIKSLLGK

SEQ ID NO: 13186 - protein, 184 aa, Amsonia hubrichtii
MASNKEMEVVKGLDLQRYMGRWYEIASFPSRFQPRNGTNTRATYTLNPDGTVHVLNETWSDGKRGSIEGSAYKADANSDEAKLKVKFYVPPFLPIIPVVGDYWVLYIDNDYQYALVGQPARKYLWILSRSPIMDEETYNQLVERAKSEGYDVSKLHKTPQPDPPPEDAPKDTKGVWWIKSLLGK

SEQ ID NO: 13187 - protein, 181 aa, Centaurea maculosa
MEVVKNVDLERYMGRWYEIASFPSFFQPRNGTNTRATYKLNEDGITVHVLNETWSDGKRSFIEGSAYKADPKSDEAKLKVKFYVPPFLPIIPVTGNYWILYLDDDYQYALVGEPSRKSLWILSRQNHIDEKIYNQLLEKAKEEGYDVSKLKKTMQTDPPPESDSAPADTKGMWWFKSLFGK

SEQ ID NO: 13188 - protein, 187 aa, Centaurea maculosa
MEADKEMEVVKNVDLERYMGRWYEIASFPSFFQPRNGTNTRATYKLNEDGITVHVLNETWSDGKRSFIEGSAYKADPKSDEAKLKVKFYVPPFLPIIPVTGNYWILYLDDDYQYALVGEPSRKSLWILSRQNHIDEKIYNQLLEKAKEEGYDVSKLKKTMQTDPPPESDSAPADTKGMWWFKSLFGK

SEQ ID NO: 13189 - protein, 185 aa, Carpinus betulus
MANKEMEVVKGVDLKRYMGRWYEIASFPSRFQPKNGENTRATYTLRDDGIVNVLNETWNDGKRGYIEGTAYKADPNSDEAKLKVKFYVPPFLPIIPVVGDYWVLFLDDDYQYALIGQPSRKYLWVLCRQTHLDDEIYNQLVERAKEKGYDVSKLHKTPQSDPPPEGEEGPKDTKGIWWIKSLLGK

SEQ ID NO: 13190 - protein, 185 aa, Carpinus betulus
MANKEMEVVKGVDLKRYMGRWYEIASFPSRFQPKNGENTRATYTLRDDGIVNVLNETWNGGKRGYIEGTAYKADPNSDEAKLKVKFYVPPFLPIIPVVGDYWVLFLDDDYQYALIGEPSRKYLWVLCRQTHLDDEIYNQLVERAKEKGYDVSKLHKTPQSDPPPEGEEGPKDTKGIWWIKSLLGK

SEQ ID NO: 13191 - protein, 184 aa, Parthenium argentatum
MAKKDMDVVKGVDLKRYMGRWYEIASFPSFFQPKNGNNTRATYTLRDDGTVHVLNETFSDGKRDSIEGTAYKADPKSDEAKLKVKFYLPPFLPIIPVTGNYWILFLDDDYQYALIGEPTRKYLWILCRQTHLDEDVYNQLVEKAKEEGYDVSKLKKTSQTDPPPADNGSTDTKGIWWIKSLFGK

SEQ ID NO: 13192 - protein, 394 aa, Cicer arietinum
METITAMDVEEQPSPTPNNVNHFALKNSIQTNFGDDYVFQIIAKDDWSAMAVSLSTNSVKLYSPVVGQYYGECKGHTATINQILFSGHSNPNILSSCSSDGTIRAWDSRTFQQVSTINAGPSQEVFSFSIGGSSGNLIAAGCDSQILLWDWRNNKQIACLEDSHVDDVTQVHFVPDEPGKLISASVDGLICIFDTTGDINEDDHLESVINVGTSIAKVGFFGESYQKLWCLTHIETLGIWDWKDARNEVNFSDARALASESWTLDNVDYFIDCHYSREAEKLWVIGGTNAGTLGYFPVSYSGMATIGAAEAILEGGHTSVVRSVLPMSRIHSGLGSSASSSIYSSDIFGWTGGEDGRLCCWLSDDSPQKNQSWISSTLIMKPERTCKKNRHHPY

SEQ ID NO: 13193 - protein, 291 aa, Vigna unguiculata
MATLESALTLFAPQRFSDNYRSSAKPPHSIKLNASTSLFFPSKVSFKSARLCFHLCSALQELPTTEKTPDPTQPTNNLTKLYVANLPWTLSPADIKNLFAQCGTVTDVEIIRNKKGRHMGYAFVTMDSGEEAQAALDKFDTYELSERIIRVEFAKQLNKPPPSPPPPPPGRRNPRETRHVLYVSNLTWKARSTHLREVFTENFKTPVSARVVFDSPAKRSAGYGFVSFLTKEDAEAAISAVDGKELMGRPLRLKFSEKKDKEAGGGKEEDQIKDAGSEDEDQSSDAQPEES

SEQ ID NO: 13194 - protein, 979 aa, Glycine max
MEVSDDVDDEHVILLCTNTDPIETTETLNDEILVSATDVLAWDLPTTLTFPTIKVQTHRNRLIERSLYFRGLLSRSFSESCLGSVTINWNVREFMQILKHMYGCVLDITLDNFLPLYEGALYFGVETLLLKCETWLSELLSPKRFQSTQIQMEDLIQIWEFGSDCASDFILHLCMGYLARNFMWAKHSKSFGKLPYDLLLSLVKHPHLTVDSELHLSDALLLWLESNTENLERPSKSEENCYEVLKQIRVGLLPLWFALGKRNSFYFRQLAEESLDSIFRLLNIAPMGSIDTFEYSDLHHLRIRLTEYSKKVDLSGCPQIASTVLLLSLIPQSYLTDPMEKNIIKQFFINCGHPIRDKSVFPLELSETFTFEAVQEVDISKCRNLIIEHAVDCFCKFFPSLRILKAAHLLNIGTISFLQLLEKCTMVCEIDLTVDITPLIPAVTVASSSRAMIPLVPEKSSSVNHIAVQIMPYNEFGPPLSNVTKLTFEGRTDVSDLGLQYISKLCVSLRHLNIKGCISVTDIGISDLISTCKKLNSIVVCDTLFGIYSVQALCSAISGSGNFPSLHSRDKRLKSVVSNFEMLHMGGCRGISESSLLELMSQAQVLKSLCLRWTDLVDQALYNFVGSSLEMLDVSDTKISGAALAHIIHGNPSLKCLRARGCQNLFPGNNCIEKRKSSFPSLHEKLHAELGKMCRLEEIEFGWGFSSFSLSALEPLLMSLKTINIGLGGTLGEDALKQLPAICPLLETIILHFQVISDMIVMNFVTSLKYLQVLALCYCFGDISMSSFKFPMQNLRKLRLERITPWMTNDDLVVLAQNCRNLLELSLLGCPLLDPDSLQIITCGWPGLVSIHLEDCGEVTANGASALLDCKALEDILLRHNGPGLPRNFICYAASEMPLLRKLSLDICDASEGDFDIPNQYADKYFLSTLKIARCKSQRCAFNLPAPAPGVHRRSVHVETLVLVWNSRDLIRTVVKERL

SEQ ID NO: 13195 - protein, 910 aa, Phaseolus vulgaris
MPDSVVTFVLDHLSQLVAHEANLLYGVEDRVQSLQNELQMINDLLNTSKRKKGIENTVVNQIRDVAHLAEDVIDTFVAKVSIYKRRTMLGRMLRGFAQARLLHQVADKIDKIKTTLNEIRENKIKYDTFKEINNQSAAEEEEEKERAQSLHKLRRDVEEENVVGFVDDSKDIIKRLLEGGSNRKVVSIIGMGGLGKTTLARKVYNNSEVKQHFECRAWVYVSNECRVRELLLGLLKHLMPNFEQQCRGKKKGKKSTQDNSSLSEEELKKLVRNSLESRTYLVVVDDLWKRQDWDEVQDVFPDNNRGSRVLITSRLKEVALHTSHDLPYHLQFLDEKESWELFCRKVFRGEDYPSDLETLGKQMVQSCRGLPLSIIVLAGLLAYKEKSHREWSKVVGHVNWYLTRDETQVKDIVLKLSYDNLPRRLKPCFLYLGIFPEDFQIPVTPLLQKWVAEGFIQDTGNRDPDEVAEDYLYELIDRSLVQKAKGKTNRNVHVHDLLRDLCISESKEDKVFEICTDNNTLIPTKPRRLSIHCKVGHYISSSNNDHSCIRSLFLFGQDDFGTGKQWKWLSKDFKLVRVLELGPTRLTTLSNFGNFIHLRYLRIEATPDFTFVPSSILHLWNLQIIDLSYWRYVTEISFPVEMWKLKHLRHLNAQGRIKLRGSCSGSDEKMWNLQTISGFVVNRQATSLIKKGTFPNLKMIRLYVTSEYRDGELTKLLQSLQQSSHLSQLEIVLWYEYDKGCKPQELLQSLGQFNCLTSLMINYVFYLLTYALTFPPNVMELELLEIGCISDEGMNGLGNLTKLKILRLTGDRCYEGDSFNLNCVEGSFSQLEVFKMKRLKLEKWKLGNGGMLRLQSLVIQDCEILEELPNELWSLSDLRKVKVRTCSESLYGRLLYLKPNNGVELILEEI

SEQ ID NO: 13196 - protein, 910 aa, Phaseolus vulgaris
MPDSVVTFVLDHLSQLVAHEANLLYGVEDRVQSLQNELQMINDLLNTSKRKKGIENTVVNQIRDVAHLAEDVIDTFVAKVSIYKRRTMLGRMLRGFAQARLLHQVADKIDKIKTTLNEIRENKIKYDTFKEINNQSAAEEEEEKERAQSLHKLRRDVEEENVVGFVDESKDIIKRLLEGGSNRKVVPIIGMGGLGKTTLARKVYNNSEVKQHFKCRAWVYVSNECRVREFLLGLLKHLMPNFEQQCRGKKKGKKSTQDNSSLSEEELKKLVRNSLESRTYLVVVDDLWKRQDWDEVQDVFPDNNRGSRVLITSRLKEVALHTSHDLPYHLQFLDEKESWELFCRKVFRGEDYPSDLETLGKQMVQSCRGLPLSIIVLAGLLAYKEKSHREWSKVVGHVNWYLTRDETQVKDIVLKLSYDNLPRRLKPCFLYLGIFPEDFQIPVTPLLQKWVAEGFIQDTGNRDPDEVAEDYLYELIDRSLVQKAKGKTNRNVHVHDLLRDLCISESKEDKVFEICTDNNTLIPTKPRRLSIHCKVGHYISSSNNDHSCIRSLFLFGQDDFGTGKQWKWLSKDFKLVRVLELGPTRLTTLSNFGNFIHLRYLRIEATPDFTFVPSSILHLWNLQIIDLSYWRYVTEISFPVEMWKLKHLRHLNAQGRIKLRGSCSGSDEKMWNLQTISGFVVNRQATSLIKKGTFPNLKMIRLYVTSEYRDGELTKLLQSLQQSSHLSQLEIVLWYEYDKGCKPQELLQSLGQFNCLTSLMINYVFYLLTYALTFPPNVMELELLEIGCISDEGMNGLGNLTKLKILRLTGDRCYEGDSFNLNCVEGSFSQLEVFKMKRLKLEKWKLGNGGMLRLQSLVIQDCEILEELPNELWSLSDLRKVKVRTCSESLYGRLLYLKPNNGVELILEEI

SEQ ID NO: 13197 - protein, 245 aa, Medicago truncatula
MLTLNLNSLSSTLPFHLNYPLFTQTQLLLPANLNYPFANTPSRKLRIFQLKAGFWESIKSGLMKNNTTQVIDPELTEEEDEEPLPQEFVLVEKTEPDGTIEKILFSSGGDLDVYDLQALCDKVGWPRRPLSKLAAALKNSYMVASLYSIRKSPGSEGNEQKILIGMARATSDHAFNATIWDVLVDPGYQGQGLGKALVEKLIRALLQRDIGNITLFADSKVVEFYRNLGFEADPEGIKGMFWYPN

SEQ ID NO: 13198 - protein, 246 aa, Arachis hypogaea
MLTLNLTPLPSSFSVANCPLFIQKTQLLIPSNLSYSFSATETRKLKTFQLKAGFWESIKSGLIKNNTTQVVDPPNVDEEDEEPLPQEFVLVEKTEPDGTIEQIIFSSGGDIDVYDLQALCDKVGWPRRPLSKLAAALKNSYIVASLHSVRKSPGSEGNEQKRLIGMARATSDHAFNATIWDVLVDPGYQGQGLGKALVEKLIRALLQKDIGNITLFADSKVVDFYRNLGFEADPEGIKGMFWYPNY

SEQ ID NO: 13199 - protein, 1023 aa, Glycine max
MESVNDLIQEAKLRTLWWALCIFVVSYFLTHTSKSMWMNVPMSILFVVGLRILFNRVEFRWKVPQPRLQTYLSHLEKKQLSLNDPRLTSLPPPAKWKRKIDSPAVEAAMSDFIDKILKDFVVDLWYSEITPDKEFPEQIRAIIMDVLAEISGRVKEINLVDLLTRDLVDLIGVHIELFRRNQATIGVDVMKTLSSEERDDRLKFHLLNSKELHPALISPESECKVLQRLMSAVLATVLRQREAQCPVIRSISRELLTCLVMQPIMNLASPGYINELIESLLLLFNDDGTQGMGSDQSTNVASHHHGHSVASEGGHNNLTASNKHPSLNQGTGMILAKTSDQGGTLLQDSILHQDSSQVRPADWARMLEVVNQRRTEILMPENLENMWTKGRNYKRKENKIIKTGSQDLPAKSPSTDSSLPHRKLAQETSASKRGKYEVAEGKSSLPPLPVMGSAPLQNVGDAKSLESSKNPDKELSIVGDLASDGYKSPLKRSSSASSLGILSNKEDSIISEFFNPEFERHSEGFRGKSSSDMIVRKEGPLVPKLRCRVVGAYFEKIGSTCFAVYSIAVTDAQNKTWFVKRRYRNFERLHRHLKDIPNYTLHLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTTWNLSWNADEIDKSIPRQSTAESVFSSDNEEGEKNNFDRDNIDRAVAQDSGLHSDNALISKGNSSRINNCDEESSNLEFDRKHDMVVEARVGNDIPATNFILVHGNLEDPVGVPPEWAPPNVSVPILDLVDNIFQLNKRGWIRRQVYWISKQILQLVMEDAIDDWLLRQIHWLRREETVSQGIRWVQDVLWPGGTFFLRVGTPQIISDSDKKPSPTMSRSGGNNITKSESGSFEQELEAARRASDIKKLLFDGAPTTLVSLIGHKQYRHCARDIYYFSQSNICVKQLAYAILELALVSIFPEIRNVVESIHQPV

SEQ ID NO: 13200 - protein, 1023 aa, Glycine max
MESVNDLIQEAKLRTLWWALCIFVVSYFLTHTSKSMWMNVPMSILFVVGLRILFNRVEFRWKVPQPRLQTYLSHLEKKQLSLNDPRLTSLPPPAKWKRKIDSPAVEAAMSDFIDKILKDFVVDLWYSEITPDKEFPEQIRAIIMDVLAEISGRVKEINLVDLLTRDLVDLIGVHIELFRRNQATIGVDVMKTLSSEERDDRLKFHLLNSKELHPALISPESECKVLQRLMSAVLATVLRQREAQCPVIRSISRELLTCLVMQPIMNLASPGYINELIESLLLLFNDDGTQGMGSDQSTNVASHHHGHSVASEGGHNNLTASNKHPSLNQGTGMILAKTSDQGGTLLQDSILHQDSSQVRPADWARMLEVVNQRRTEILMPENLENMWTKGRNYKRKENKIIKTGSQDLPAKSPSTDSSLPHRKLAQETSASKCGKYEVAEGKSSLPPLPVMGSAPLQNVGDAKSLESSKNPDKELSIVGDLASDGYKSPLKRSSSASSLGILSNKEDSIISEFFNPEFERHSEGFRGKSSSDMIVRKEGPLVPKLRCRVVGAYFEKIGSTCFAVYSIAVTDAQNKTWFVKRRYRNFERLHRHLKDIPNYTLHLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTTWNLSWNADEIDKSIPRQSTAESVFSSDNEEGEKNNFDRDNIDRAVAQDSGLHSDNALISKGNSSRINICDEESSNLEFDRKHDMVVEARVGNDIPATNFILVHGNLEDPVGVPPEWAPPNVSVPILDLVDNIFQLNKRGWIRRQVYWISKQILQLVMEDAIDDWLLRQIHWLRREETVSQGIRWVQDVLWPGGTFFLRVGTPQIISDSDKKPSPTMSRSGGNNITKSESGSFEQELEAARRASDIKKLLFDGAPTTLVSLIGHKQYRHCARDIYYFSQSNICVKQLAYAILELALVSIFPEIRNVVESIHQPV

SEQ ID NO: 13201 - protein, 1036 aa, Cajanus cajan
MESVNDLIQEAKLRTLWWALCIFAVSYFLTHTSKSMWMNVPMSILFVSGLRFLFNKVEFRWKVQQPRKQTYLSHLEKKQLSLNDPRLSSLPPPAKWKRKIDSAPVEAAMSDFIDKILKDFVVDLWYSEITPDREFPEQIHAIIMDVLAEISGRVKEINLVDLLTRDLVDLVGDHLELFRRNQADIGVDVMKTLSSKERDDRLKFNLLNSKELHPALISPESEYKVLQRLMSAVIATVLRQREAQCPVIRSIARELLTCLVMQPIMNLASPGYINELIESLLLLFNDDGTKGMGSDQSTNVASHYHRHSVASEGGHHNLTASNKHSSLNQGTDMVLAKMSDQGGKPLQYNSLNQESSQVRPADWAQMLEVATQRRTEILMPENLENMWTKGRNYKRKENKIIKTGFQDLPAKNPSTDSSLPQRKLTQETSASNRGKYEVAEGKSSLPPMQAMGSDPLQNVGSAKISESSQNPDKELAFAGDLGVDKMKSIKDLASDGYKSPLKRSNSASSLGILLNKEGGSIISEFYNPEFERHSDGFRGKSSSDMIVRKEGPLVPKLRCRVVGAYFEKLGSTCFAVYSIAVTDAQNKTWFVKRRYRNFERLHRHLKDIPNYTLHLPPKRIFSSNTDDAFVHQRCIQLDKYLQDLLSIANVAEQHEVWDFFSVSSKNYSFGKSPSVMKTLAVNVDDAMDDIVRQFKGVSDGLRRRVVGSSSLINEGSATSTTWNLSWNADEIDKSFTTKGTSESVLSSDNEEGEKNSNFDQENIHSDVAQVSGLYSDNALISKSYPSPINKRDEESSNLNFDRKHDMVVEARVGNDVPSTNFILINDNLEDPVGVPPEWAPPNVSVPILNLVDKIFQLKKRGWIRRQVYWISKQILQLVMEDAIDDWLLRQIHWLRREETVAQGIRWVQNVLWPDGTFFLRVETPRIISSDSDQKPFQTMSRSGGSNITKSESGSFEQELEAARRASDIKKLLFDSAPSTLVSLIGHKQYRHCARDIYYFSQSNTCVKQLAYAILELALVTIFPEMRNVVLSIHQPV

SEQ ID NO: 13202 - protein, 1022 aa, Glycine max
MESVNDLIQEAKLRTLWWALCIFAVSYFLTHTSKSMWMNVPMSILFVVGLRILFNRVEFRWKLQQPRPQTYLSHLEKKQLSLNDPCLTSLPSPAKWKRKIDSPAVEAAMSDFIDKILKDFVVDLWYSEISPDKEFPEQIRAIIMDVLAEISGRVKEINLVDLLTRDLVDLIGVHIELFRRNQAVIGVNIMKTLSSEERNDRLKFHLLNSKELHPALISPESEYKVLQRLMSAVLATVLRQREAQCPVIRSISRELLTCLVMQPIMNLASPGYINELIESLLLLFNDDGTEGMGSDQSTNVASLHHGHSVASKGGHNNLTASNKHPSLNQGTDMILAKMSDQGGTSLQDSTLHQESKQVGPADWARMLEVTTQRRTEILMPENLENMWTKGRNYKRKENKIIKAGSKDLSAKSPSTDSSRPHRKLAQETSASKRGKYEVADGKSSLPPLPAIGSDPLQNVGSAKNSESPKNPGKELSIVGDLASDAYRSPLKRSSSASSLGILSNKEDSRISEFFNPELERHSEGFRGKSSSNMIVRKEGSLVPKLRCRVVGAYFEKIGSTCFAVYSIAVTDAQNKTWFVKRRYRNFERLHRHLKDIPNYTLQLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTPWNLSWNADEIDKSIPRQSTAESVSSDNEEGERNNFDRENIDREAAQDSGLHSYNALISKGYSSRISNWDEESRNLDFDRKHDMVVEARAGNGIPATNFILIHDNLEDPVGVPPEWTPPNVSVPILNLVDNIFQLNKRGWIRRQVYWISKQILQLVMEDAIDDWLLRQIHWLRREETVSQGIRWVQDVLWPGGTFFLRVGTPQIISDSDKKSSPTMSRSGGSNITKSESGSFEQELEAARRASDIKKLLFDGAPTTLVSLIGHKQYRRCARDIYYFSQSNVCVKQLAYAILELALVSIFPEIRNVVKSIHQPV

SEQ ID NO: 13203 - protein, 387 aa, Glycine max
MAEEITKNDVGVTSKTTRSSSRFWPRWIPTSTDHIIAAEKRLLSVVKTGYVQEHVNIGSGPPGSKVRWFRSSSNEPRFINTVTFDSKPHSPTLVMIHGYAASQGFFFRNFDALASRFRVIAVDQLGWGGSSRPDFTCKSTEETEAWFIDSFEEWRKAKNLSNFILLGHSFGGYVAAKYALKHPEHVQHLILVGSAGFSSESDAKSEWITRFRATWKGAVLNHLWESNFTPQKLVRGLGPWGPNIVRKYTSARFGTHSTGEILTEEESTLLTDYVYHTLAAKASGELCLKYIFSFGAFARMPLLLSASEWKVPTTFMYGFQDWMNYQGAQEARKHMKVPCEIIRIPQGGHFAFIDNPTAFHSAVFYACRRFLTPDPDNESLPKGLTSA

SEQ ID NO: 13204 - protein, 385 aa, Cicer arietinum
MAEEISKNGLGSSSKSRSFWSALRWIPTSTDHIIAAEKRLLSIIKTGYVQEHVNIGSGPPGSKVRWFRSSSDEPRFINTVTFDSKPDSPTLVMVHGYAASQGFFFRNFDALASRFRIIAVDQLGWGGSSRPDFTCRSTEETEAWFIDSFEEWRKAKNLSNFILLGHSFGGYVASKYALKHPEHVQHLILVGPAGFSSESDAKSEFITKFRATWKGAVLNHLWESNFTPQKLVRGLGPWGPNMVRKYTSARFGTHSTGQTLTEEESSLLTDYVYHTLAAKASGELCLKYIFAFGAFARMPLLHSAPEWKVPTTFIYGYQDWMNYQGAQEARKQMKVPCEIIRVPQAGHFVFIDNPSGFHSAVFYACRRFLSPDPDNESLPEGLSSA

SEQ ID NO: 13205 - protein, 391 aa, Lupinus angustifolius
MAQEIRKNDVGLSSSSSSSSRRLWPSVLRWIPTSTDHIIASEKRLLSILKTPYVQEHVNIGSGPPGSKVRWFRSLSNKPRFINTVTFDSKDDSPTLVMVHGYGASQGFFFRNFDALASRFRVIAVDQLGWGGSSRPDFTCRSTEETEEWFIDSFEEWRKAQNLSKFILLGHSFGGYVAAKYALKHPEHVQHLILVGSAGFSSESDANQSEWFTKFRTTWKGSVMNHLWESNFTPQKLVRGLGPWGPDIVRKYTSARFGTHSTGEVLTEEESRLLTDYVYHTLAAKASGELCLKYIFSFGAFTKSPLVGSASEWKVPTTFIYGFQDWMKYEGAQEARKHMKVPCEIIRVPKGGHFVFIDNPNAFHSSVFYACRKFLTPDPDNEPLPQGLTLA

SEQ ID NO: 13206 - protein, 386 aa, Medicago truncatula
MAEEIRQKDDVDSSSKSKSFWSSLRWIPTSTDHIIAAEKRLLSIIKTGYAQEHVNIGSGPPGSKVRWFRSTSNEPRFLNTVTFDSKPDSPTLVMVHGYAASQGFFFRNFDALASRFRIIAVDQLGWGGSSRPDFTCKSTEETEAWFIDSFEEWRKAKNLTNFILLGHSFGGYVASKYALKHPQHVQHLILVGPAGFTEETDPKTEFVTKFRATWKGAVLNHLWESNFTPQKIVRGLGPWGPNMVRKYTSARFGTHSTGQKLIDEESSLLTDYVYHTLAAKASGELCLKYIFAFGAFARMPLLQSAQEWKVPTTFIYGYEDWMNYEGAQEARKHMKVPCEIIRVPKAGHFVFIDNPSGFHSAVFYACRRFLTPNSDNESLPEGLSSA

SEQ ID NO: 13207 - protein, 389 aa, Vitis vinifera
MAEEMTKAELGSSSSTTKSRSLWPSLFRWIPTSTDHIIDAEKRLLSLVKTPYVQEQVNIGSGPPGSKVRWFRSASNEPRFINTVTFDSKDDSPTLVMVHGYGASQGFFFRNFDALARRFRVIAIDQLGWGGSSRPDFTCKSTEETEAWFIDSFEEWRKAKNLSNFILLGHSVGGYVAAKYALKHPEHIQHLILVGPAGFSLESDGKSEWLTRFRATWKGAVLNHLWESNFTPQKLVRGIGPWGPDLVRKYTSARFSSYSTGDLLTEEESKLLTDYVYHTVAAKASGELCLKYIFSFGAFARLPLLHSASEWKVPTTFIYGFEDWMNYQGAQEARKQMKVPCEIIRVPQAGHFVFIDNPSGFHSAVLYACRRFLLPDPDSQSLPEGLTSA

SEQ ID NO: 13208 - protein, 380 aa, Cannabis sativa
TTSTPSMSKSRSFWPSVLRWIPTSTDHIIASEKRLLSIVKTPYVQEQVNIGSGPPGSKIRWFRSSSNEPRFINTVSFDSKSDSPTLVMVHGYGASQGFFFRNFDALASRFKVIAIDQLGWGGSSRPDFTCKSTEETEAWFIDSLEEWRKAKNLSNFILLGHSFGGYVAAKYALKHPEHVKHLILVGSAGFSSEADGMSERLTRFRATWKGALLNHLWESNFTPQKIIRGLGPWGPNLVQKYTTARFSSYSTGNVLTEEESKLLTDYVYHTLAAKASGELCLKYIFSFGAFARMPLLHSASEWKVPTTFIYGYEDWMNYQGAQEARKNMKVPCEIIRVPQAGHFVFIDNPNDFHSAVFYACRRFLSPNSDKESLPEGLIPA

SEQ ID NO: 13209 - protein, 392 aa, Lotus japonicus
MAAAEEISKNDNAGLSSSKTKSFWSWPSSLRWIPTSTDLVIAAEKRLLSIIKTGYVQERVNIGSGPPGSKVRWFGSSSNEPRFINTFTFDSKPDAPTLVMVHGYAASQGFFFRNFDALAARFRVIAVDQLGWGGSSRPDFTCKSTEETEAWFIDSFEEWRKAKNLTNFILLGHSFGGYVAAKYALKHPEHVQHLILVGPAGFTTESDKATEFITKFRKTWKGAVMNHLWESNFTPLKIVRGIGPLGPTMVRKYTSARFGTHSTGEVLTEEESKLLTDYVYHTLAAKASGELCLKYIFSFGAFARMPLLLSASEWKVPTTFIYGFQDWMNYEGAQETRKNMTVPCEIIRVPQAGHFVFIDNPSGFHSSVFYACRRFFTPDPDSESLPEGLTSA

SEQ ID NO: 13210 - protein, 427 aa, Aquilegia formosa
MIRRWSNSVILKNKKKMSEQINNTTTTKAKAAVAAAANVEAVTSSSSSTTSSTSRGIGIWPSILRWIPTSTDHIIDSEKRLLSLVKTPYVQEMVNIGSGPPGSNVRWFRSTSDQPRFINTVTFDSKEGSPTLVMVHGYAASQGFFFRNFDALASRFKVIAIDQLGWGGSSRPDFTCKSTEETEAWFIDSFEEWRKSKNLSNFILLGHSFGGYVAAKYALKHPEHVQHLILVGPAGFSSDSDASKSEWLTRFRATWKGAIANHLWESNFTPQKVIRGLGPWGPNLVRRYTSARFGAYSTGELLTEEESRLLADYTYHTLAAKASGELCLKYIFSFGAFARLPLLHSASEWKVPTTFIYGFHDWMNYQGAQEARKDMKVPCEILRVPQAGHFAFIDNPNGFHSAVFHACRRFLSSDSSNESLPEGLTSA

SEQ ID NO: 13211 - protein, 411 aa, Manihot esculenta
MNLLRLRVTSSISKMAEELGSSAAATTATSTSSTSSSWAKTRSLWPSILRWIPTSTDRIIAAEKRLLSLVKTPYVQEQVNIGSGPPGSKVRWFRSASNEPRFINTVTFDSKEDSPTLVMVHGYAASQGFFFRNFDALASRFKVIAVDQLGWGGSSRPDFTCKSTEETEAWFIDSFEEWRKAKGLNNFILLGHSFGGYVAAKYALKHPEHVQHLILVGSAGFSSESEAKSEWLTRFRATWKGAILNHLWESNFTPQKVIRGLGPWGPGLVHRYTTARFGAYSSGEVLTEEEAKLLTDYVYHTLAAKASGELCLKYIFSFGAFARMPLLQSASEWKVPTTFIYGFQDWMNYQGAQEARKHMNVPCEIIRVPQGGHFVFIDNPNGFHSAVLYACRRFLSPNPHSESLPEGLVSA

SEQ ID NO: 13212 - protein, 389 aa, Trigonella foenum-graecum
MAEEISQNDVASSSSSSSSKSTKSFWSALRWIPTSTDHIIAAEKRLLSIIKTGYVQERVNIGSGPPGSKVRWFRSASDEPRFLNTVTFDSKPDSPTLVMVHGYAASQGFFFRNFDALASRFRIIAVDQLGWGGSSRPDFTCKSTEETEAWFIDSFEEWRKAKNLSNFILLGHSFGGYVASKYALKHPEHVQHLILVGPAGFTSEETDPIVPKLRATWKGAVLNHLWESNFTPQKIVRGLGPWGPNMVRKYTSARFGTHSTGQKLIEVESSLLTDYVYHTLAAKASGELCLKYIFAFGAFARMPLLQSAPEWKVPTTFIYGYEDWMNYEGAQEARKHMKVPCEIIRVPKAGHFVFIDNPSGFHSAVFHACRRFLTPNSDNESLPEGLSSA

SEQ ID NO: 13213 - protein, 235 aa, Cucurbita pepo
MAKIKNHQQFILLGHSFGGYVAAKYALKHPEHIKHLILVGPAGFSSESDAKSDETITRFRATWKGAILSHLWESNFTPQKLVRGLGPWGPNLVHKYTSARFGTYSIGDILNDEESRLLSDYVYHTLAAKASGELCLKYIFAFGAFARMPLLQSASEWKVPTTFIYGYEDWMKYQGAQEARKNMKTPCEILRVPQAGHFVFIDNPTSFHSTVFYACRRFLSPDPDKDSLPEGIISA

SEQ ID NO: 13214 - protein, 401 aa, Euphorbia peplus
MTDHLGSTAAAADTSAATSTSPNSKSSWAKTRSLWPSVLRWIPTSTDHIIDAEKRLLSAVKTPYVQEQVNIGSGPPGSKVRWFRSESNEPRFLNTVTFDSKEDAPVLVMVHGYAASQGFFFRNFDVLASRFKVIAVDQLGWGGSSRPDFTCKSTEETEAWFIDSFEEWRKAKNLTNFILLGHSFGGYVASKYALKHPEHVQHLILVGPAGFSSESEAKSEWLTRFRASWKGAVLNHLWESNFTPQKVIRGFGPWGPNLVRRYTNARFGVHSNGEVLTEEESALLTDYVYHTLAAKASGELCLKYIFSFGAFARMPLLQSASEWKVPTTFIYGYQDWMNYQGAQEARKQMKVPCEIIRVPQGGHFVFIDNPNLFHSAVFYACRKFISSDPDNQSLPGGLTSV

SEQ ID NO: 13215 - protein, 414 aa, Panax ginseng
MNLRLRPWDSKLKSNFKLLASMTEEISSVPPPAAAIATKTGEKKSSLWPSVLRWIPTSTDHIIAAEKRLLSLVKTPYTQEKVNIGSGPPGSKVRWFRSVSDEPRFINTVTFDSKEGNPTLVMIHGYGASQGFFFRNFDFLANHFKVIAIDQLGWGGSSRPDFTCKSTEETEAWFIDSFEEWRKSKNLSNFILLGHSFGGYVAAKYALKHPEHIQHLILVGSAGFSSESDHKSEWLIRFRATWKGAILNHLWESNFTPQKVVRGFGPWGPDLVRKYTTARFGAYSTGDVLTEEESKLLTDYVYHTLAAKASGELCLKYIFSFGAFARSPLLHSASEWKVPTSFIYGFDDWMNYQGAQEARKNMNVPCDIIRVPQGGHFVFVDNPSGFHSAVLYACRRFLSSDPDNYPFPEGLTSA

SEQ ID NO: 13216 - protein, 414 aa, Panax ginseng
MNLRLRPWDSKLKSNFKLLASMTEEISSVPPPAAAIATKTGKKKSSLWPSVLRWIPTSTDHIISAEKRLLSLVKTPYTQEKVNIGSGPPGSKVRWFRSVSDEPRFINTVTFDSKEGNPTLVMIHGYGASQGFFFRNFDFLANHFKVIAIDQLGWGGSSRPDFTCKSTEETEAWFIDSFEEWRKSKNLSNFILLGHSFGGYVAAKYALKHPEHIQHLILVGSAGFSSESDHKSEWLTRFRATWKGAILNHLWESNFTPQKVVRGFGPWGPDLVRKYTTARFGAYSTGDVLTEEESKLLTDYVYHTLAAKASGELCLKYIFSFGAFARSPLLHSASEWKVPTSFIYGFDDWMNYQGAQEARKNMNVPCDIIRVPQGGHFVFVDNPSGFHSAVLYACRRFISSDPDNYPFPEGLTSA

SEQ ID NO: 13217 - protein, 65 aa, Panax ginseng
MNYQGAQEARKNMNVPCDIIRVPQGGHFVFVDNPSGFHSAVLYACRRFISSDPDNYPFPEGLTSA

SEQ ID NO: 13218 - protein, 406 aa, Cucumis melo
MTINRLRISSSFAKMAEEISKAGLGTSTSASETAKSRSLWPSLLRWIPTSTDHIIAAEKRLLSLVKTPYVQERVNIGSGPPGSKVRWFRSSSDEPRFINTVTFESKPESPTLVMIHGYAASQGFFFRNFDALASRFRVIAVDQLGWGGSSRPDFTCKSTEETEAWFIDSFEEWRKAKNISNFILLGHSFGGYVAAKYALKHPEHINHLILVGPAGFSSELDAKSEWITKFRATWKGAVLSHLWESNFTPQKLVRGLGPWGPDLVRRYTSSRFGTYSIGDILNDEESTLLSDYVYHTLAAKASGELCLKYIFAFGAFARMPLLQSASEWKVPTTFIYGFQDWMNYQGAQEARKSMKTPCEILRVPQAGHFVFIDNPSSFHSTVFYACRRFLSSEPDKESLPEGIISA

SEQ ID NO: 13219 - protein, 406 aa, Citrullus lanatus
MTINRLRISSSFAKMAEEISKAGLGTATSAAEKAKSRSLWPSVLRWIPTSTDHIIAAEKRLLSLVKTPYVQERVNIGSGPPGSKVRWFRSSSDEPRFINTVTFDSKPESPTLVMIHGYAASQGFFFRNFDALASRFRVIAVDQLGWGGSSRPDFTCKSTEETEAWFIDSFEEWRKAKNISNFILLGHSFGGYVAAKYALKHPENIKHLILVGPAGFSSESDAKSETITRFRATWKGAILSHLWESNFTPQKLVRGLGPWGPDLVRKYTSSRFGTYSIGDVLNDEESRLLSDYVYHTLAAKASGELCLKYIFAFGAFARMPLLQSASEWKVPTTFIYGFQDWMNYQGAQEARKSMKTPCEILRVPQAGHFVFIDNPSSFHSTVFYACRRFLSSEPDKESLPEGIISA

SEQ ID NO: 13220 - protein, 238 aa, Phaseolus vulgaris
METQYEELATEDSILDSSSEDVEEEEIEKELADVTFEELQKARSNGAHAFFQKPKEDKKLKRANKNRPMEASSKKPVSAFREAIQAPKKVVRDPRFESLCGTLDPEGFRKRYNFLYENDLPAERQALKKELKKYKDPKRISEIEEHISWIDKQMKSDSRKNIDTQILARHKKKEREAAKEGKRPFYIKKSEIRKQRLFEKYNNLKSSGKLEAFVEKRRRRNAAKDHRYMPYRRSGDVE

SEQ ID NO: 13221 - protein, 132 aa, Vigna unguiculata
QIQIFISEKNLKQTVPKTSDLMIMEKASLPQVHNTESKRLPSSLVSPIHSLIINKCHQQTTIFNPQSWAAKTHRYFSFWCYIPVYNYSLRKNVKATKFIPHHQIYDTACICGPWQHSFSSFSPQMLQVCQMT

SEQ ID NO: 13222 - protein, 251 aa, Glycine max
MTQKQRDRVPDSMETQYEESEKDESSSAYSSSEDEEEEEIEKELADVTFEELQKARSNGTHAFFQKPKEDKKLKRANKNRPMEASSKKPVSGFREVIQAPKKVVRDPRFESLCGKLDPEGFRKRYNFLYENDLPAERQALKKELKKYKDPKRINEIEERVSWIDKQLKSDSAKHIDAEILAKHKKKEREATKQGKRPFYLKKSEIRKQRLIEKYNHLKSSGKLEAFVEKRRRRNAAKDHRYMPYRRSGDVE

SEQ ID NO: 13223 - protein, 250 aa, Glycine max
MTQKQRTRIPDSMETQYEESEKDESSSSYSSSEDEEEEIEKELADVTFEELQKARSNGAHAFFQKPKEDIKLKRANKNRPMEASSKKPVTGFREVIQAPKKVVRDPRFESLCGKLDPDGFRKRYNFLYENDLPAERQALKKELKKYKDPKRVNEIEERISWIDKQVKSDSAKHIDAEILAKHKKKEREAAKQGKRPFYLKKSEIRKQRLIEKYNHLKSSGKLEAFVEKRRRRNAAKDHRYMPYRRSGDVE

SEQ ID NO: 13224 - protein, 252 aa, Lupinus angustifolius
MKKYFNSGIEGSSETQYEDSEIEDSSSSSSSSSEDEEEEIGKELADVTFEELQKARSNGAHAFFQKPKEDQKLKRANKNRPMEASSKKPVAAFREVIQAPKKVVRDPRFESLCGTLDTDGFRKRYNFLFESDLPAEKEALKKDLRKYKDPERIHEIEERLSWIDKQLKSGSSKHIDAKILANHKKKEREAAKQGKRPFYIKKSEIRKQRLVEKYNHLKSSGKLESFVEKRRKRNAAKDHRYMPYRRSGDNME

SEQ ID NO: 13225 - protein, 171 aa, Trigonella foenum-graecum
MEASSKKPVPAFRDVIQAPKKVVRDPRFESLCGTLDTDRFRKRYNFLYENDLPAERQALKKDLKKYKDPEHRSEIEERISWVDKMLKSDSTKNIETEILAKHKKKEREAAKQGKRPFYLKKSEIRKQRLVEKYNNLKSSGNLESYIEKKRKRNAAKDHRFMPYRRSGDNVE

SEQ ID NO: 13226 - protein, 252 aa, Medicago truncatula
MNKHGSRIPNSNNETHYEENETEDSLSSSSSSEDEEEEEIEKELADVTFEELQKARSNGAHAFFKKPAEDKKLKRANKNRPMEASSKKPVPAFRDVIQAPKKVVRDPRFESLCGTFDNDGFRKRYNFLYENDLPAERQALKRQLRKYKDPERRSEIEERIAWVDKQLKSDSTKNIETQILAKHKKKEREAAKQGKRPFYLKKSEIRKQRLVDKYNHLKSSGNLESYIEKKRKRNAAKDHRFMPYRRSGENVE

SEQ ID NO: 13227 - protein, 251 aa, Cicer arietinum
MKKHETRMPSSTETQYEESETDESLSSSSLSEDEDEEEIKKELADVTFEELQKARSDGAHAFIKKRGEDNKLKRANKNRPMEASSKKPVPAFRDVIQAPKKVVRDPRFESLCGTLNNDGFKKRYNFLYENDLPAERQALKKELKKCKDSERISEIEGHISWIDKQLKSDSTKNIETQILAKHKKKEREAAKQGKRPFYLKKSEIRKQRLIENYNHLKSSGKLESYIEKKRKKNAAKDHRFMPYRRPGDNLE

SEQ ID NO: 13228 - protein, 140 aa, Lupinus angustifolius
MTKYNKSGIAGSSEPQYEQSEMDSSSSSSSEDEEEEIEKELADVTFEELQKARSNGAHAFSKKPREDQKLKRANKNRPMEASSKKPVPAFREVVQAPKKVVRDPRFESLCGTLDTDGFRKRYNFLLKVIFLLKKRLLRRN

SEQ ID NO: 13229 - protein, 249 aa, Lupinus angustifolius
MKKDNKSGIAGSSEPQYKLSEMDESSSSSSEDEEEEIEKELADVTFEELQKARSNGAHAFSKKPREDQKLKRANKNRPMEASSKKPVPSFREVVHAPKKVVRDPRFESLCGTLDTDGFRKRYNFLFESDLPAEKEALKKELRRYKDPERIHEIEERLSWIDKQLKSGSAKHIDAKILANHKKKEREAAKQGKRPFYIKKSEIRKQRLIEKYKHLKSSGKLESFVEKKRRRNAAKDHRYMPYRRSGDNME

SEQ ID NO: 13230 - protein, 683 aa, Cajanus cajan
MSGGGCSIVWFRRDLRVEDNPALAAGVRAGAVVAVFIWAPEEEGQYYPGRVSRWWLKQSLAHLDSSLRSLGTPLITKRSTNSVSSLLEVIKSTGATQLFFNHLYDPLSLVRDHRAKEVLTAQGIVVRSFNSDLLYEPWDVNDAHGQPFTTFSAFWERCLSMPYDPQAPLLPPKRIIPGDVSRCPGDTLVFEDELEKASNALLARAWSPGWSNADKALTTFINGPLIEYSKNRRKADSATTSFLSPHLHFGEVSVKKVFHLVRIKQVFWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTQWIHHPWNAPESVLQAAGIELGSNYPLPIVGIDAAKVRLQEALIQMWQQEAASRAAMENGTEEGLGDSSESAPIAFPQDIQMEERLEPVRNNPPHGTRRYEDQMVPSITSSHVRVEEEETSSDLRNSAADSRAEVPINVNTQPDARGTVNQGALQNVNRNTRVQNNANATMWLRNAAEDSTAESSSSTRRERDGGEVPVWSPPASNFSEQFVDDENGIGASSSYLQRQHPQSHQLMNWTRLPQTG

SEQ ID NO: 13231 - protein, 681 aa, Glycine max
MSGGGCSIVWFRRDLRVEDNPALAAGVRAGAVISVFIWAPEEEGQYYPGRVSRWWLKQSLAHLDSSLRNLGSPLITKRSTNSISSLLEVVKSTGATQLFFNHLYDPLSLVRDHRAKEVLTAQGITVRSFNSDLLYEPWDVNDAHGQPFTTFSAFWERCLSMPYDPQAPLLPPKRIIPGDVSRCPSDTLVFEDELEKASNALLARAWSPGWSNADKALTAFVNGALIEYSKNRRKADSATTSFLSPHLHFGEVSVKKVFHLVRIKQVFWANEGNKAGEESVNLFLKSIGLREYSRYISFNHPYSHERPLLAHLKFFPWVVNEGYFKAWRQGRTGYPLVDAGMRELWATGWLHDRIRVVVSSFFVKVLQLPWRWGMKYFWDTLLDADLESDALGWQYISGTLPDGRELDRIDNPQFEGYKCDPNGEYVRRWLPELARLPTEWIHHPWNAPESVLQAAGIELGSNYPLPIVGIDAAEVRLQEALIQMWQQEAASRAAMENGTEEGLGDSAESAPIAFPQDIQMEERPEPVRNNLPHGTRRYQDQMVPSITSSHVRVEEEETSSDLRNSAADSRAEVPINVTTQQIARETVNQGVLLNANRNTRVQNNATTWLRNAAEDSTAESSSSTRRERDGGVVPVWSPPASNFSEQFVDDENGIGAGSSYLQRQHPQSHQLMNWTRLPQTG

SEQ ID NO: 13232 - protein, 681 aa, Glycine max
MSGGGCSIVWFRRDLRVEDNPALAAGVRAGAVVCVFIWAPEEEGQYYPGRVSRWWLKQSLAHLDSYLRNLGSPLITKRSTNSISSLLEVVKSTGATQLFFNHLYDPLSLVRDHKAKEVLTAQGITVRSFNSDLLYEPWDVNDAHGQPFTTFSAFWERCLSMPYDPQAPLLPPKRIIPGDVSRCPSDTLVFEDESEKASNALLARAWSPGWSNADKALAAFVNGALIEYSKNRRKADSATTSFLSPHLHFGEVSVKKVFHLVRIKQVFWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPNGEYVRRWLPELARLPTEWIHHPWNAPESVLQAAGIELGSNYPLPIVGIDAAEVRLQEALIQMWRQEAASRAAMENGTEEGLGDSSESAPIAFPQDIQMEERPEPVRNNPPHGTRRYQDQMVPSITSSHVRVEEEETSSDLRNSAADSRAEVPINVTTQQNARETVNQGVLLNTNRNTRVQNNPTTWLRNAAEDSTAESSSSTRRERDGGVVPVWSPPASNFSEQFVDDENGIGTGSSYLQRQHPQSHQLMNWTRLPQTG

SEQ ID NO: 13233 - protein, 683 aa, Lotus japonicus
MSGGGACSIVWFRRDLRVEDNPALAAGVRAGAVVAVFIWAPEEEGQYYPGRVSRWWLKNSLATLDSSLRSLGTPLITKRSTDSVSSLLEVVKSTGATQIFFNHLYDPLSLVRDHRAKEVLTAQGITVRSFNSDLLYEPWDVNDANGQPFTTFDAFWERCLTMPYDPQAPLLPPKRIIPGDASRCPSDTLVFEDESEKASNALLARAWSPGWSNADKALTAFINGPLIEYSKNRRKADSATTSFLSPHLHFGEVSVKKVFHLVRIKQVLWANEGNIAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTIPDGRELDRIDNPQFEGYKCDPNGEYVRRWLPELSRLPTEWIHHPWNAPESVLQAAGIELGSNYPLPIVGIDAAKARLQEALLQMWQQEAASRAAMENGTEEGLGDSSESAPIAFPQDMIMEEERHEPVRNNPPHGTRRYQDQMVPSITSSHVRVEEEEIASDLRNSAQDNRAEVPMNVNTQQNAREAVNQGVLQTINRNNTQLQHNNTVWLRNAAEDSTAESSSSTRRERDGGVVPVWSPPASSFSEQFVDDENGIGASSSYLQRHPQSHQMMNWTRLPQTG

SEQ ID NO: 13234 - protein, 682 aa, Arachis hypogaea
MSGGGGCSIVWFRRDLRVEDNPALAAGVRAGAVVAVFVYAPEEEGQYYPGRVSRWWLKNSLAHLDSSLRSLGTPLITKRSTDSVSSLLDVVKSTGATQLFFNHLYDPLSLIRDHRAKEVLTAQGITVRSFNSDLLYEPWDVNDSNGQPFTTFSAFWERCLSMPYDPQAPLLPPKRIIPGDVSRCQGDTLVFEDESEKASNALLARAWSPGWSNADKALTAFINGPLIEYAKNRRKADSATTSFLSPHLHFGEVSVKKVFHLVRIKQVLWANEGNQAGEESVNLFLKSIGLREYSRYISFNHPYSHERPLLGHLKFFPWVINESHFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEYVRRWLPELSRLPTEWIHHPWNAPESVLQAAGIELGSNYPLPIVGIDAAKARLQEALIQMWQLEAASRAAIENGVEEGLGDSTELAPIAFPEDIQMEESHEPVRNNPPVGPRRYEDQMVPSMTSSLVRVEEEEASSVLRNLAEESRAEVPTNATAQQNARETVNQGVLQNVNRNTQVQHNNTTAWLRNAAEDSTAESSSSTRRERDGGVVPVWSPPSSSYAEPFVDDESGIGASSSYLQNHPQSHRLMNWTRLPQTG

SEQ ID NO: 13235 - protein, 681 aa, Cicer arietinum
MTSGGCSIVWFRRDLRVEDNPALAAGVRAGAVVAVFIWAPEEEGQYYPGRVSRWWLKNSLSQLDSSLRSLGTPLITKRSTDSVSSLLEVVKNTGATQIFFNHLYDPLSLVRDHKAKEVLTTQGITVRSFNSDLLYEPWDVNDEHDQPFTTFDSFWERCLSMPYDPQAPLLPPKRIIPGDVSRCPSDTLVFEDESEKASNALLARAWSPGWSNANKALTTFINGPLIEYAKNRRKADSATTSFLSPHLHFGEVSVKKVFHLVRIKQVFWANEGNQAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRAAAENGTEEGLGDSSESTPIAFPQDIQMEEIHEPVRNNPPHGTRRYEDQMVPSITSSRVRMEEEETSSVRNSGEDSRAEVPTNANGQQNTRETESQGVLQNVNRNTRQRNNTPTTFWLRNAPEDSTAESSSSTRRERDGGVVPEWSPPTSNFSDQFVDDENGIGSSSPYLQRHPQSHQLMSWTRLPQTG

SEQ ID NO: 13236 - protein, 679 aa, Medicago truncatula
MSSSGGGCSIVWFRRDLRVEDNPALAAGVRAGAVVGVFIWAPEEEGQYYPGRVSRWWLKNSLAHLDSSLRNLGTPLVTKRSTDSVSSLLEVVKSTGATQIFFNHLYDPLSLVRDHRAKEILTAQGITVRSFNSDLLYEPWDVNDENGQPFTTFDSFWERCLSMPYDPQAPLLPPKRIIPGDVSKCPSDTLVFEDDLEKASNALLARAWSPGWSNANKALTTFINGPLIEYSKNRRKADSATTSFLSPHLHFGEVSVKKVFHLVRIKQVFWANEGNEAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRAAAENGTEEGLGDSAESTPIAFPQDIQMEERHEPIRNNAPHGTRRYQDQMVPSMTSSRVRVEEEETSSVRNSAGDSRAEVPTNANAREAMNQGALQNGNRNTRQRHNPTTTFWLRNAAEDSTAESSSSTRRERDGGVVPEWSPQASNFSDQYVDDENGIGATSPYLQRHPQSHQLMSWTRLPQTG

SEQ ID NO: 13237 - protein, 682 aa, Pisum sativum
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFGEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 13238 - protein, 679 aa, Lupinus angustifolius
MSSGGCSIVWFRRDLRVEDNPALMAGVRAGSVVAVFIWAPEEEGQYQPGRVSRWWLKHSLAYLDSSLRNLGTPLITKRSTDSVSALLEVVKSTGATQLFFNHLYDPLSLIRDHRTKEVLTAHGITVRSFNSDLLYEPWDVNDDHGQPFTTFDAFWERCLNMPYDPQSPSLPPKRIIPGDTSRCPSDTLVFEDESEKSSNALLARAWSPGWSNADKALTTFINGPLIEYSENRRKADSATTSFLSPHLHFGEVSVKKVFHLVRIKQVLWANEGNKAGEESVNLFLKSIGLREYSRYISFNHPYSHERPLLGHLKFFPWMVNEGYFKAWRQGRTGYPLVDAGMRELWATGWLHDRIRVVVSSFFVKVLQLPWRWGMKYFWDTLLDADLESDALGWQYITGTLPDGREFDRIDNPQFEGYRFDPNGEYVRRWLPELSRLPTQWIHHPWNAPESVIQAAGIELGSNYPLPIVGIDEAKARLQQALLQMWQQEAAYRAATENGTEEGLGDSFESTPIAFPDDIQMEERHEPVRNNPPAAAATRRYEDQMVPSITSSLVRVEEEETSLDVQNSAEESRAEVPVNVIAQQNARETVLRTATRNTQLPHNNTTMWLRNAAEDSTAESSSSTRRERGGGEVPVWSPTASSYPEPFVDDENGIGPSSSYLQRHPQSHQLMNWTRLPQTG

SEQ ID NO: 13239 - protein, 682 aa, Glycine max
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYDPLSLVRDHRAKEVLTAQGITVRSFNADLLYEPWDVNDAHGRPFTTFAAFWERCLSMPYDPESPLLPPKRIIPGDASRCPSDTLLFEDELEKASNALLARAWSPGWSNANKALTTFINGPLIEYSKNRRKADSATTSLLSPHLHFGELSVKKVFHLVRIKQVLWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELSRLPTEWIHHPWNAPESVLQAAGIELGSNYPLPIVGIDAAKNRLLEALSKMWQQEAASRAAMENGTEEGLGDSSESVPAAFPQDTRMEETHEPVRNNPLPIARRYQDQMVPSITSSLLRVEEEETSSDLRNSAEESSRAEVPVTANAQQNAGVALNERMLQTTNRNTQTQYNTTMDLRNVADDSAVESSSGTRRERDGGLVPVWSPPASSYSEQFVGDENGITSSSSYLQRHPQSHQMLNWKQLPQTG

SEQ ID NO: 13240 - protein, 681 aa, Populus trichocarpa
MSGGGCSIVWFRRDLRVEDNPALAAGVRAGAVVAVFVWAPEEEGHYYPGRVSRWWLKQSLAHLDSSLRSLGTSLVTKRSTDSVSTLLEVIKSTGATQLFFNHLYDPLSLVRDHRAKEVLTAQGIAVRSFNADLLYEPWDVNDAQGRPFTTFATFWDRCLSMPFDPEAPLLPPKRIISGGASRCPSEMLVFEDELEKGSNALLARAWSPGWSNADRALTTFINGPLIEYSKNRRKADSATTSFLSPHLHFGEVSVRKVFHLVRIKQVLWANEGNKAGEESVNLFLKSIGLREYSRYLSFNHPYSHERPLLGHLKFFPWVVDEGYFKAWRQGRTGYPLVDAGMRELWATGWLHDRIRVVVASFFVKVLQLPWRWGMKYFWDTLLDADLESDALGWQYITGTLPDGREFDRIDNPQFEGYKFDPNGEYVRRWLPELARLPTEWIHHPWNAPESVLQAAGIELGSNYPLPIVGIDAAKVRLEEALSEMWQQEAASRAAIENGTEEGLGDSSESAPIAFPQDINMEENHEPVRNNPPATNRRYEDQMVPSMTSSFLRIEDEETSSDVRNSTGDGRAEVPRDVNVNQQPRRDTLNQGFVQSVHNDNSLPPFNVLRGPANVEDSTAESSSSSRRERDGGIVPVWSPPASSYSEQFVGDENGIGATSSYLPRHPQSHQILNWRRLPQTG

SEQ ID NO: 13241 - protein, 679 aa, Lupinus angustifolius
MSSNGCSIVWFRRDLRVEDNPALMAGVRAGAVVAVFIWAPEEEGQYQPGRVSRWWLKHSLAYLDSSLRNLGTPLITKRSTDSVSALLEVVKSTGATQLFFTHLYDPLSLIRDHRAKEVLSAHGITVRSFNSDLLYEPWDVNDEHGQPFTTFDAFWERCLNMPYDPPAPFLPPKRIIPGDISRCSCDALVFEDESEKASNALLARAWSPGWSNADKALTTFINGPLIEYSENRRKADSATTSFLSPHLHFGEVSVKKVFHLVRIKQVLWANEGNKAGEESVNLFLKSIGLREYSRYVSFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYITGTLPDGREFDRIDNPQFEGYKFDPNGEYVRRWLPELSRLPTQWIHHPWNAPESVLQAAGIELGSNYPLPIVAIDEAKARLQEALIQMWQQEAAYRAATENGTEEGLGESFESTPIAFPEDIQMEEGHESVRNNTPAASTRRYEDQMVPSITSSLVRVEGEETSLDVQNSAEESRAEVPINVNAQQNTRETVFHTANRNTQLQHNNNNTTWFRNGAEDSTAESSSSTRRERDGGEVPVWSPTTSSYPEPFVDDENGLGGSSSYLQRHPQSHQLMNWTRLPQTG

SEQ ID NO: 13242 - protein, 681 aa, Glycine max
MSGGGGSIVWFRRDLRIEDNPALTAGVRAGAVVAVFVWAPEEEGQYYPGRVSRWWLKNSLAHLHSSLRNLGTPLITKRSTDTLSSLLEVVKSTGATQLFFNHLYDPLSLVRDHRAKEVLTAQGITVRSFNADLLYEPWEVNDAHGRPFTTFAAFWERCLSMPYDPESPLLPPKRIIPGDASRCPSDTLLFEDELEKASNALLARAWSPGWSNANKALTTFINGPLIEYSKNRRKADSATTSLLSPHLHFGELSVKKVFHLVRIKQVLWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELARLPTEWIHHPWNAPESVLQAAGIELGSNYPLPIVGIDAAKTRLLEALSEMWQQEAASRAAMENGTEEGLGDSSESVPAAFPQDMQMEETHEPVRNNPLPVARRYQDQMVPSITSSLLRVEEEETSSDLRHSAEESSRAEVPVTANAQQNVGVTLNERMLQTTNRNAQTQYNTTMELRNVAEDSAVESSSGTRRERDGGVVPVWSPPASSYSEQFVGEENGITNSSSFLQRHPQSHQMLNWRQLPQTG

SEQ ID NO: 13243 - protein, 681 aa, Quercus alba
MSGGGCSIVWFRRDLRLEDNPALQAGVRAGAVVAVFIWAPEEEGHYYPGRVSRWWLNHSLAHLDSSLRSLGTSLITKRSTDTISSLLEVVKSTGASQLFFNHLYDPLSLVRDHRAKEVLTAQGIAVRSFNADLLYEPWDVNDAHGRPFTTFAAFWERCLSMPYDPESPLLPPMRIVSGDVSRCPSDALVFEDESEKGSNALLARAWSPGWSNADKTLTTFINGPLIEYSKNRRKADSNTTSLLSPHLHFGEVSVRKVFHLVRIKQVLWANEGNQAGEESVNLFLKSIGLREYSRYFCFNHPYSHERPLLGHLKYFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPHGEYVRRWLPELARIPTEWIHHPWNAPEPVLQAAGIELGSNYPLPIVGIDAAKARLQEALSETWQQEAASRAVIENGTEEGLGDSSESTPIAFPQDIQMAENHEPVRNNPPTTIRRYEDQMVPSMTSSLVRVEEEEPSLDIQNLAADSRAEVPTDGHVNQEATRNTLNPAVVQNVHSHNLPQFNTPIVLRNAAEDSTAESSSSIRRERDGGVVPVWSPSTSSYSEQFVGDENGIGTSSSYLQRHPQSHQIVNWRRLSQTG

SEQ ID NO: 13244 - protein, 682 aa, Theobroma cacao
MSGGACSIVWFRRDLRVEDNPALAAGVRAGAVVAVFIWAPEEEGHYYPGRVSRWWLKQSLAHLDSSLRSLGTCLISKRSTESVSSLLEVVKSTGATQLFFNHLYDPISLVRDHRAKEVLTAHGVAVRSFNADLLYEPWDVNDAQGRPFTTFAAFWEKCLSMPYDPEAPLLPPKRIISGDVSNCPSHPLAFEDESEKGSNALLARAWSPGWSNADKALTTFINGPLIEYSKNRRKADSATTSFLSPHLHFGEVSVRKVFHLVRIKQVLWANEGNEAGEESVNLFIKSIGLREYSRYLSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPHGEYVRRWLPELARLPTDWIHHPWNAPESVLQAAGIELGSNYPLPIVGIDAAKARLQEALSEMWQQEAASRAAIENGTEEGLGDSSESAPFAFPQDIQMEENLEPARNNAPATTRRYEDQMVPSMTSSLVRGEDEEPSLDLRTSAEESRAEVPRNLSMDQEPRRDILNQGVPQTVRNSNTFLQFNIPTGVGNAEDSTAESSSSSGRRERDGGVVPVWSPPASSYSEQFIGDENGIGGSSSYLQRHPRSHQIVNWRRLSQTG

SEQ ID NO: 13245 - protein, 681 aa, Unknown
  Sequence found in Organisms: Citrus clementina, Citrus sinensis
MSGRGCSIVWFRRDLRVEDNPALAAGVRAGAVIAVFIWAPEEEGPYYPGRVSRWWLKHSLSHLDSSLRSLGTSLVTKRSTDSVSSLLEVVKATGATQLFFNHLYDPLSLVRDHRAKEALTAQGIAVRSFNADLLYEPWDVNDAQGQPFATFAAFWEKCLSMPFDPDAPLLPPKRINSGDMSRCPSDTLVFEDESEKGSNALLARAWSPGWSNADKALTTFINGPLIEYSKNRRKADSATTSFLSPHLHFGEVSVRKVFHLVRIKQVSWANEGNKAGDESVNLFLKSIGLREYSRYMSFNHPYSHERPLLGHLKFFSWVVDEGYFKAWRQGRTGYPLVDAGMRELWATGWLHDRIRVVVSSFFVKVLQLPWRWGMKYFWDTLLDADLESDALGWQYISGTIPDGRAFDRIDNPQFEGYKFDPNGEYVRRWLPELARLPTEWIHHPWNAPESVLQAAGIELGSNYPFPIVRIDAAKCRLDEALSEMWQQEAASRAAIENGTEEGLGDSSDSAPIAFPPDIQMEEIPEPARNNLPTTARRYEDQMVPSMTTSLVRVEEEESSLELRNSAEESRAEVPRNANVNQEPRRDTLNQGVLQTVHNNNAFQQFNAAIVLANAEDSTAESSSTSRRERDGGVVPVWSPATSSYSEQLVGDENGIGTSSSYLQRHPQSHQIMNCRRLSQTG

SEQ ID NO: 13246 - protein, 681 aa, Vitis vinifera
MSGGGCSIVWFRRDLRVEDNPALAAGVRAGAVIPVFIWAPEEEGPYYPGRVSRWWLKQSLAHLDSSLRSLGTPLITKRSTDCVSSLLEIVKSTGATLLFFNHLYDPLSLVRDHRAKEALTAQGIAVHSFNADLLYEPWDVNDAQGHSFTTFSAFWDRCLSMPYDPEAPLLPPKRINPGDVSRCPSDTIAFEDESEKGSNALLARAWTPGWSNADKALTIFINGPLIEYSKNSRKADSATTSFLSPHLHFGEVSVRKVFHLVRIKQVLWANEGNKAGEESVNLFLKSIGLREYSRYLSFNHPYSHERPLLGHLKFFPWVVDEGYFKAWRQGRTGYPLVDAGMRELWATGWMHDRIRVVVSSFFVKVLQLPWRWGMKYFWDTLLDADLESDALGWQYISGTLPDGREFDRIDNPQFEGYKFDPNGEYVRRWLPELARLPTEWIHHPWNAPESVLQAAGIELGSNYPLPIVEIDAAKARLQEALSEMWQAVAASRAAIENGTEEGLGDSESAPIAFPQDVQMEEIPEPVRNNPTTTAVRRYEDQMVPSMTSSFLRIEGEPSLDIQNSAENSRAEVPTNVNANQEPRRETLNRGVTHSVRSNNHNLPQFNIMIGRNTAEDSTAESSSTTRRERDGGVVPVWSPSTSSYAEQFVSEENGIGTSSSYLQRHPRSHQLMNWKQLSQTG

SEQ ID NO: 13247 - protein, 682 aa, Gossypium raimondii
MSGSACSIVWFRRDLRVEDNPALAAGVRAGAVVAVFVWAPEEEGHYYPGRVSRWWLKHSLAHLDSSLRSLGTCLITKRSSDSVSSLLEVVKSTGATQLFFNHLYDPISLVRDHRAKEVLTAHGVAVRSFNADLLYEPWDVNDAQGRPFTTFSSFWERCLSMPYDPEAPLLPPKRIISGDVTTCHSDELVFEDESEKGSNALLARAWSPGWSNADKALTTFINGPLIEYSKNRRKADSATTSFLSPHLHFGEVSVRKVFHLVRIKQVLWANEGNKAGEESVNLFLKSIGLREFSRYLSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLLDGREFDRIDNPQFEGYKFDPHGEYVRRWLPELARLPTDWIHHPWNAPESVLQAAGIELGSNYPLPIVGIDAAKDRLQEALSVMWQQEAASRAAIENGTEEGLGDSSESVPFAFPQDIQMEENVEPARNDAPATTRRYEDQMVPSMTSSLVRGIHEEASSDLRTSTEDSRAEVPRNVNIHQEPQRDSLNQGIQLTARNNNTFRQFNLPMGLGNAEDSTADSSTSSSRRERDGGVVPVWSPPASSYSEQFIGDENGIGTSSSYLPRHPQSHQIVNWRRLSQTG

SEQ ID NO: 13248 - protein, 681 aa, Populus trichocarpa
MSGGGCSIVWFRRDLRVEDNPALAAGVRAGAVVAVFVWAPEEEGHYYPGRVSRWWLKQSLAHLDSSLRSLGTSLVTKRSTDSVSSLLEVVKSTGATQLLFNHLYDPLSLVRDHRAKEILTAQGITVRSFNADLLYEPWDVNDAQGRPFTTFDTFWERCLSMPFDPEAPLLPPKRIISGDVSRCPSVTLVFEDESEKGSNALLARAWSPGWSNADRALTTFINGPLIEYSMNRRKADSATTSFLSPHLHFGEVSVRKVFHLVRIKQVLWANEGNRAGEESVNLFIKSIGLREYSRYLSFNHPCTHERPLLGHLKFFPWVVDEGYFKAWRQGRTGYPLVDAGMRELWAAGWLHDRIRVVVASFFVKVLQLPWRWGMKYFWDTLLDADLESDALGWQYITGTLPDSREFDRIDNPQFEGYKFDPNGEYVRRWLPELARLPTEWIHHPWNAPESVLQAAGIELGSNYPLPIVGIDAAKVRLEEALSEMWQQEAASRAAIENGTEEGLGDSSESAPIAFPEDIHMEENHEPVRNNPPATNRRYEDQMVPSMTSSFLRIEDEETSSDVRNSTGDGRAEVPRDVNVNQEPRRDALNQGFVQTVRNNTALSPFNILRGLTNVEDSTAESSSSSRRERDGGIVPVWSPPTSSYSEQFVGDDNGIGATSSYLQRHPQSHQIINWRRLSQTG

SEQ ID NO: 13249 - protein, 682 aa, Gossypium raimondii
MSGSACSIVWFRRDLRVEDNPALAAGVRAGAVVAVFVWAPEEEGHYYPGRVSRWWLKHSLAHLDSSLRSLGTCLITKRSSDSVSSLLEVVKSTGATQLFFNHLYDPISLVRDHRAKEVLTAHGVAVRSFNADLLYEPWDVNDAQGRPFTTFSSFWERCLSMPYDPEAPLLPPKRIISGDVTTCHSDELVFEDESEKGSNALLARAWSPGWSNADKALTTFINGPLIEYSKNRRKADSATTSFLSPHLHFGEVSVRKVFHLVRIKQVLWANEGNKAGEESVNLFLKSIGLREFSRYLSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLLDGREFDRIDNPQFEGYKFDPHGEYVRRWLPELARLPTDWIHHPWNAPESVLQAAGIELGSNYPLPIVGIDAAKDRLQEALSVMWQQEAASRAAIENGTEEGLGDSSESVPFAFPQDIQMEENVEPARNDAPATTRRYEDQMVPSMTSSLVRGIHEEASSDLRTSTEDSRAEVPRNINIHQEPQRDSLNQGIQQTARNNNTFRQFNLPMGLGNAEDSTADSSTSSSRRERDGGVVPVWSPPASSYSEQFIGDENGIGTSSSYLPRHPQSHQIVNWRRLSQTG

SEQ ID NO: 13250 - protein, 679 aa, Prunus mume
MSGGGCSVVWFRRDLRVEDNPALAAGVRAGSVVCVFIWAPEEEGPYYPGRVSRWWLKHSLAHLDSSLRSLGTSLITKRSTDSVSSLLEVVISTGATQLFFNHLYDPISLVRDHRAKEVLTAQGIAVRSFNADLLYEPWDVNDVNGRPFTTFDAFWGRCLSMPYDPDAPLLPPKRIISGDTSRCPSDTLVFEDESEKGSNALLARAWSPGWSNADKALTTFINGPLLEYSQNRRKADGATTSLLSPHLHFGEVSVRKAFHLVRIKQVLWANEGNKAGEESVNLFLKSIGLREYSRYISFNHPYSHERPLLGHLKFFPWIINQSYFKAWRQGRTGYPLVDAGMRELWATGWLHDRIRVVVSSFFVKVLQLPWRWGMKYFWDTLLDADLESDALGWQYISGTIPDGREFDRIDNPQFEGYKFDPNGEYVRKWLPELARLPTEWIHHPWNAPESVLQAAGIELGSNYPLPIVGIDAAKTRLQEALLEMWQHEAASRAAVENGTEEGLGDSSESTPIAFPQDIQMEENYEPVRNNLPATRRYEDQMVPSITTSLVRVEEEESSLDIRNLVEETRGEVPTNEMVNQEPRRDTLNQGVLQTIRNNTLPQPNAAIGLQHAIEDSTAESSGSSRRERDGGVVPVWSPSTSSYSEQFASDDNSIGTSSYLQRHPQSHQIMNWRRLSQTG

SEQ ID NO: 13251 - protein, 677 aa, Manihot esculenta
MSGGCSIVWFRRDLRVEDNPALAAGVRAGAVVAVFIWAPEEEGHYYPGRVSRWWLKQSLAHLGSSLRSLGTTLVTKRSTDSVSALLEVVKSTGATQLFFNHLYDPLSLVRDHRAKELLTAQGVAVRSFNADLLYEPWEVNDAQGSPFTTFGEFWERCLSMPYDPEAPLLPPKRIISGDISRCPSNLLIFEDESEKGSNALLARAWSPGWSNADKALMTFINGPLIEYSKNRRKADSATTSFLSPHLHFGEVSVRKVFHLVRMKQVLWANDGNKAGEESVNLFLKSIGLREYSRYLSFNHPYSHERPLLGHLKFFPWVVDEGYFKAWRQGRTGYPLVDAGMRELWATGWLHDRIRLVVSSFFVKVLQLPWRWGMKYFWDTLLDADLESDALGWQYISGTLPDGREFDRIDNPQFEGYKFDPNGEYVRRWLPELARLPTEWIHHPWNAPESVLQAAGIELGSNYPLPVVWIDAAKVRLQEALSEMWQQEAASRAAIENGTEEGLGDSSESALIAFPQDILMEERHEPVRNNLPSTIRRYEDQMVPSITTSLLRVEEEETSSDLRNVTEDTRAEVPRNVNINQEQRRDNLNLGAAQTIRENNLAHFSVVRSLGIEDSTEESSSSSRRERDGGIVPVWSPPSASYSEQFAGDENGIGTSPYLQRHPQSHQILNWRRLSQTG

SEQ ID NO: 13252 - protein, 679 aa, Prunus persica
MSGGGCSVVWFRRDLRVEDNPALAAGVRAGSVVCVFIWAPEEEGPYYPGRVSRWWLKHSLAHLDSSLRSLGTSLITKRSTDSVSSLLEVVISTGATQLFFNHLYDPISLVRDHRAKEVLTAQGIAVRSFNADLLYEPWDVNDVNGRPFTTFDAFWGRCLSMPYDPDAPLLPPKRIISGDTSRCPSDTLVFEDESEKGSNALLARAWSPGWSNADKALTTFINGPLLEYSQNRRKADGATTSLLSPHLHFGELSVRKAFHLVRIKQVLWANEGNKAGEESVNLFLKSIGLREYSRYISFNHPYSHERPLLGHLKFFPWIINQSYFKAWRQGRTGYPLVDAGMRELWATGWLHDRIRVVVSSFFVKVLQLPWRWGMKYFWDTLLDADLESDALGWQYISGTIPDGREFDRIDNPQFEGYKFDPNGEYVRKWLPELARLPTEWIHHPWNAPESVLQAAGIELGSNYPLPIVGIDAAKTRLQEALLEMWQHEAASRAAVENGTEEGLGDSSESTPIAFPQDIQMEENYEPVRNNLPATRRYEDQMVPSMTTSLVRVEEEESSLEIRNLVEETRGEVPTNEMVNQEPRRDTLNQGVLQTIRNNTLPQPNAAIGLQHAIEDSTAESSGSSRRERDGGVVPVWSPSTSSYSEQFASDDNSIGTSSYLQRHPQSHQIMNWRRLSQTG

SEQ ID NO: 13253 - protein, 254 aa, Euonymus alatus
MSGGGCSIVWFRRDLRVEDNTALLAGVRAGAVVAVFIWAPEEEGQYNPGRVSRWWIKHSLAHLESSLRSLGTTLITKRSTDSVATLLEIVKSTGATQLFFNHLYDPMSLVRDHRAKEVLGAHGVAVRSFNADLLYEPWDVNDAQGRPFTTFAAFWERCLSMPYDPEAPLLPPKRIISGDVSRCPSDTLIFEDESEKGSNALLARAWSPGWSNADKAMTTFLNGALIEYSENRRKADSATTSFLLPPPSFWGGKC

SEQ ID NO: 13254 - protein, 140 aa, Ricinus communis
MSGGGCSIVWFRRDLRVEDNPALAAGVRAGAVVAVFVWAPEEEGHYYPGRVSRWWLKQSLAHLDSSLRSLGTVLVSKRSTDSVSSLLEVVKSTGATQLFFNHLYDPISLVRDHRAKEVLTAQGIAVRSLTRICYMNPGMP

SEQ ID NO: 13255 - protein, 691 aa, Vitis vinifera
MSGGGCSIVWFRRDLRVEDNPALAAGVRAGAVIPVFIWAPEEEGPYYPGRVSRWWLKQSLAHLDSSLRSLGTPLITKRSTDCVSSLLEIVKSTGATLLFFNHLYDPLSLVRDHRAKEALTAQGIAVHSFNADLLYEPWDVNDAQGHSFTTFSAFWDRCLSMPYDPEAPLLPPKRINPGDVSRCPSDTIAFEDESEKGSNALLARAWTPGWSNADKALTIFINGPLIEYSKNSRKADSATTSFLSPHLHFGEVSVRKVFHLVRIKQVLWANEGNKAGEESVNLFLKSIGLREYSRYLSFNHPYSHERPLLGHLKFFPWVVDEGYFKAWRQGRTGYPLVDAGMRELWATGWMHDRIRVVVSSFFVKVLQLPWRWGMKYFWDTLLDADLESDALGWQYISGTLPDGREFDRIDNPQFEGYKFDPNGEYVRRWLPELARLPTEWIHHPWNAPESVLQAAGIELGSNYPLPIVEIDAAKARLQEALSEMWQAVAASRAAIENGTEEGLGDSESAPIAFPQDVQMEEIPEPVRNNPTTTAVRRYEDQMVPSMTSSFLRIEGEPSLDIQNSAENSRAEVPTNVNANQEPRRETLNRGVTHSVRSNNHNLPQFNIMIGRNTAEDSTAESSSTTRRERDGGVVPVWSPSTSSYAEQFVSEENGIGTSSSYLQRHPRSHQLMNWKQLSQTGYKNLGRGESD

SEQ ID NO: 13256 - protein, 673 aa, Fragaria vesca
MSGGSGCSVVWFRRDLRVEDNPALLAGVRAGGVVALFIWAPEEEGPYYPGRVSRWWLKHSLAHLDSSLRSLGTPLITKKSTDSVSSLLEVCLATGATQLFFNHLYDPISLVRDHRAKEVLSANGITVRSFNADLLYEPWDVNDVHGRPFTTFDAFWERCLSMPFDPEAPLLPPKRIISGDASRCPPDTLVFEDESEKGSNALLARAWSPGWSSADKAVTTFINGPLIEYSTNRRKADSNTTSLLSPHLHFGEVSVRKVFHLIRIKQLLWANEGNKAGEESVNLFLKSIGLREYSRYISFNHPYSHERPLLGHLKFFPWVINQNYFKAWRQGRTGYPLVDAGMRELWATGWLHDRIRVVVSSFFVKVLQLPWRWGMKYFWDTLLDADLESDALGWQYISGTIPDGREFDRIDNPQFEGYKCDPHGEYVRRWLPELSRLPTDWIHHPWNAPESVLQAAGIELGSNYPLPIVGIEAAKSRLQEALTEMWQHERAAAENGTEEGLGESSESTSIAFPEDIQMEDSHEQVRNNPPPPTRRYEDQMVPSITTSLVRVEEEESSLDLPSRAEVPTNVTGDQEPMRDTMNQEGFQPNHNNTPPQPNTTLTLQYVVEDSTAESSSSTRRERDGGVVPVWSPSNSSYSEQFVSDENGIATSSYLQRHPQSHQIMNWRRLSQTG

SEQ ID NO: 13257 - protein, 673 aa, Manihot esculenta
MSGGCSIVWFRRDLRIEDNPALAAGVRAGAVVAVFIWAPEEEGHYYPGRVSRWWLKQSLAHLDSSLRSLGTPLVTKRSTDSVSTLLEVVKSTGATHIFFNHLYDPLSLVRDHRAKEILTAQGIAVRSFNADLLYEPWDVNDAQGRPFTTFAAFWETCLSMPYDPEAPLLPPKRIISGDISRCPSDLLIFEDESEKGSNALLARAWSPGWSNADKALTTFINGPLIEYSKNRRKADSATTSFLSPHLHFGEVSVRKVFHLVRIKQVLWANEGNKAGEESVNLFLKSIGLREYSRYMSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGRAFDRIDNPQFEGYKFDPHGEYVRRWLPELARLPTEWIHHPWNAPESLLQAAGIELGSNYPLPIVGIDAAKVRLQEALSEMWQQEAAFRAAIENGTEEGLGDSSESAPFAFPQDMQMEETHELVRNNLPTTIRRYEDQMVPSITSLLRVEDEETSSDIQNVAEDSRGVVPRNVNVNQEQSRYALNQGAAQTIHGNNNLPHFSVVSDPGNVEDSTAESSSSSRGIVPVWSPPTASYSDQFAGDENGIGTSSYLQRHPQSHQIMNWRRLSQNG

SEQ ID NO: 13258 - protein, 682 aa, Tripterygium wilfordii
MAGGGCSIVWFRRDLRVEDNPALLAGVRAGAVVAVFIWAPEEEGHYNPGRVSRWWIKHSLAHLESSLRSLGTTLLTKRSTDSVATLLEIVKSTGATQLFFNHLYDPMSLVRDHRAKEVLGAHGVAVRSFNSDLLYEPWDVNDAQGHPFTTFTAFWERCLSMPYDPEAPLLPPKRIISGDVSRCPSDSLMFEDESEKGSNALLARAWSPGWSNADKALTTFLNGALIEYSTNRRKADAATTSFLSPHLHFGEVSVRKVFHLVRIKQVLWANEGNKAGVESVNLFLKSIGLREYSRYMSFNHPYSHERPLLGHLKFFPWVVDEGYFKAWRQGRTGYPLVDAGMRELWATGWLHDRIRVVVASFFVKVLQLPWRWGMKYFWDTLLDADLESDALGWQYISGTLPDSRELDRIDNPQFEGYKFDPNGEYVRRWLPELARLPTEWIHHPWNAPESVLEAAGIELGSNYPLPVVGIDAAKVRLQQALSAMWQQEAASRAVMENGTEEGLGESTESAPFAFPQDTLMEENHEPVRNNPPATIRRYEDQMVPSITCSLVRVEEEETSSVRNFAEEGRAEVPRDIHVNQEPTRDPLNQEVTQNRLGNSTMPQFNITIALGNAEDSTAESSSSGNGRRERDGGVVPVWSPPTSSFSEHFVGDENGIGTSSSYLQSHPQSHQIMSWRRLSQTG

SEQ ID NO: 13259 - protein, 681 aa, Amsonia hubrichtii
MSGGGCSIVWFRRDLRVEDNPALAAGVRAGAVVAVFIWAPEEEGHYHPGRVSRWWLKHSLAHLDSSLRSLGTALVTKRSTDSISSLLEVVKSTGATQLFFNHLYDPISLVRDHRAKEVLTAQGVTVHSFNGDLLYEPWEVHDEEGRPFRTFAAFWERCLSMPYDPEAPLLPPKRIISGDVSRCPSDNLIFEDESEKGSNALLARAWSPGWSNANKALTTFINGPLIEYSKNRRKADSATTSFLSPHLHFGEVSVRKVFHLVRIKQVLWANEGNRAGEESVNLFLKSIGLREYSRYMSFNHPYSHERPLLGHLKYFPWVLDEDYFKAWRQGRTGYPLVDAGMRELWATGWLHDRIRVVVSSFFVKVLQLPWRWGMKYFWDTLLDADLESDALGWQYISGTLPDGREFDRMDNPQFEGYKFDPNGEYVRRWLPELARLPTEWIHHPWNAPESVLQAAGVELGSNYPLPIVGIDAAKARLVEALSQMWQLEAASRAAIENGTEEGLGDSESGPIAFPQYMQVEMDQQPIRNNPTTAVIRRYEDQMVPSITSSLLRMEDEETSVDLRNSAASSRAEVPITANVTEEPVREAFNQPHTPTVQNNHTMHQFSFPVGRRNSEDSTAESSIGGRRERDGGVVPVWSPSSSNFSDPFVSEDNGLGASSSYLQRHPESHQLMNWRRLSQTG

SEQ ID NO: 13260 - protein, 679 aa, Solanum lycopersicum
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEVHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 13261 - protein, 679 aa, Solanum lycopersicum
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEGHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 13262 - protein, 679 aa, Malus domestica
MSGGGCSVVWFRRDLRVEDNPALAAAVRAGGVVCVFIWAPEEEGPYYPGRVSRWWLKHSLAHLDCSLKSLGTSLITKRSTDSVSSLLEVVVSTGATQLFFNHLYDPISLVRDHRAKEVLTAQGIAVRSFNADLLYEPWDVNDVHDCPFTTFDAFWGRCLSMPYDPDAPLLPPKRIISGDVSRCPSDTLVFEDESEKGSNALLARAWSPGWSNADKALTTFINGPLLDYSYNRRKADGATTSLLSPHLHFGEVSVRKAFHLARMKQVLWANESNKAGEESVNLFLKSIGLREYSRYISFNHPYSHERPLLGHLKFFPWVINQNYFKAWRQGRTGYPLVDAGMRELWATGWLHDRIRVVVSSFFVKVLQLPWRWGMKYFWDTLLDADLESDALGWQYISGTIPDGREFDRIDNPQFEGYKCDPNGEYVRKWLPELARLPTEWIHHPWNAPESVLQAAGIELGSNYPLPIVGIDAAKTRLQEALSEMWQHEAASRAAVENGTEEGLGDSSESVPIAFPQDIQMEENNEPARNNPPGTRRYEDQMVPSITTSLVRAEEEETSLELQNLTEETRAEVPTDLIVNQEPRRDMLNQGVFQTTRNNALPPPNAAIGMQHAVEDSTAESSSSTRRERDGGVVPVWSPSSSSYSEQFGSEDNSIGTSSYLQRHPQSHQIMNWRRLSQTG

SEQ ID NO: 13263 - protein, 681 aa, Nicotiana benthamiana
MSGGGCSIVWFRRDLRVEDNPALAAGVRAGAVIAVFIWAPEEEGHYYPGRVSRWWLKQSLAHLDSSLKSLGTSLVTKRATDSISSLLGIVKSTGATQLFFNHLYDPISLVRDHRAKEVLTAQGISVRSFNADLLYEPWEVNDEEGRPFTTFSAFWEKCLSMTYDPEAPLLPPKRIIPGDASRSSSDSLVFEDESEKGSNALLARAWSPGWSNADKALTTFVNGPLLEYSQNRRKADSATTSFLSPHLHFGEVSVRKLFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPHGEYVRRWLPELSRLPTEWIHHPWNAPESVLEAAGIELGSNYPLPIVEIDAAKVRLEQALSQMWQHEAASRAAIENGMEEGHGDSADSPIAFPQAMHMEMDHEPVRNNNPVIVTVRRYEDQMVPSMTSSLFRVDDEETSVNIRNSVVDTRAEVPNDVNVTEGPRRDTLDQAVTQRARTNATPPQFNFVVGRRNSEDSTAESSSSTRERDGGVVPVWSPSSTNYSDQYVGDDNGIGTSSSYLQRHPQSHQLMNWQRLSQTG

SEQ ID NO: 13264 - protein, 679 aa, Eucalyptus grandis
MSGCSIVWFRRDLRVEDNPALAAGVRSGSVLAVFIWAPEEEGAYYPGRVSRWWLKHSLAHLDSSLRSLGTCLITRRSTDSVSSLLELVKSTGATQLFFNHLYDPISLVRDHRAKEVLNAQGINVHSFNADLLYEPWEVNDDQGHPFTTFAGFWEKCLSMPYDPESPLLPPKRIISGDVSRCPSEALVFEDESEKGSNALLARAWSPGWSNADKALTTFVNGPLLEYSKNRRKADSATTSFLSPHLHFGEVSVRKVFHLVRIKQVLWANEGNKAGEESVNLFLKSIGLREYSRYMSFNHPYSHERPLLGHLKYFPWVVDEGHFKAWRQGRTGYPLVDAGMRELWATGWLHDRIRVVVSSFFVKVLQLPWRWGMKYFWDTLLDADLESDALGWQYISGTIPDGREFDRIDNPQFEGYKFDPNGEYVRRWLPELARLPTEWIHHPWNAPESVLQAAGIELGSNYPLPIVSIDAAKVRLQDALSIMWQHEATSRAAIENGTEEGLGDSSESAPIAFPQDIQMEENHETMRNNPPGPVHRYEDQMVPSITSLVRADEEETSSGIQNSIGDTRAEVPANVNLNEEPRRDTLNEGVFQQLRPNNTQPMYNFSPGLHNDAEDSTAESSSTGRRERDGGVVPVWSPSTSSYSDQIAGDENGIGNGSAFLQRHPQSHQIINWRRLSQTG

SEQ ID NO: 13265 - protein, 673 aa, Gossypium raimondii
MSSIVWFRRDLRVEDNPALLAGVRAGPVFAVFIWAPEEEGHYQPGRVSRWWLKHSLALLDSSLRSLGTCLITKRSTDSVSSLLQIVKSTGATQLFFNHLYDPISLVRDHRAKEVLTAHGVAVRSFNADLLYEPWDVNDDNGRPFTTFTAFWEKCLNMPFDPEAPLLPPKRIISGDVLTCTTDVLVFEDELEKGSNALLARAWSPGWSNADKALTTFINGPLIEYSKNRRKADSATTSFLSPHLHFGEVSVRKVFHLVRMKQVLWANEGNKAGEESVNLFLKSIGLREYSRYLSFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEYVRRWLPELARLPTDWIHHPWNAPESVLQAAGIELGSNYPLPIVGIDAAKSRLQEALSEMWQLEAASRAAIENGTEEGLGDSSESVPFAFPQDIQMEENIEPARNNAPATTRRYEDQMVPSITSSLLRGEHEESSSYLRTSAEDSRAEVPGTVNINREQRRDTLNQAIPETARSLQLNFPIGLRNAEDSTAESSSSSRRERDGGVVPVWSPPSSSYPEQFIGEESGIGASSSFLQGHPQSHQIINWRRLSQTG

SEQ ID NO: 13266 - protein, 673 aa, Gossypium raimondii
MSSIVWFRRDLRVEDNPALLAGVRAGPVFAVFIWAPEEEGHYQPGRVSRWWLKHSLALLDSSLRSLGTCLITKRSTDSVSSLLQIVKSTGATQLFFNHLYDPISLVRDHRAKEVLTAHGVAVRSFNADLLYEPWDVNDDNGRPFTTFTAFWEKCLNMPFDPEAPLLPPKRIISGDVLTCTTDVLVFEDELEKGSNALLARAWSPGWSNADKALTTFINGPLIEYSKNRRKADSATTSFLSPHLHFGEVSVRKVFHLVRMKQVLWANEGNKAGEESVNLFLKSIGLREYSRYLSFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEYVRRWLPELARLPTDWIHHPWNAPESVLQAAGIELGSNYPLPIVGIDAAKSRLQEALSEMWQLEAASRAAIENGTEEGLGDSSESVPFAFPQDIQMEENIEPARNNAPATTRRYEDQMVPSITSSLLRGEHEESSLYLRTSAEDSRAEVPGTVNINREQRRDTLNQAIPETARSLQLNFPIGLRNAEDSTAESSSSSRRERDGGVVPVWSPPSSSYPEQFIGEESGIGASSSFLQGHPQSHQIINWRRLSQTG

SEQ ID NO: 13267 - protein, 681 aa, Nicotiana benthamiana
MSSGGCSIVWFRRDLRVEDNPALAAGVRAGAVIAVFIWAPEEEGHYYPGRVSRWWLKQSLAHLDSSLKSLGTSLVTKRSTDSISSLLEIVKSTGATQLFFNHLYDPISLVRDHRAKEVLTAQGISVRSFNADLLYEPWEVNDEEGRPFTTFSAFWEKCLSMPYDPEAPFLPPKRIIPGDASGCSSDSLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPHGEYVRRWLPELSRLPTEWIHHPWNAPESVLEAAGIELGSNYPLPIVEIDSAKVRLEQALSQMWQHEAAARAAIENGMEEGHGDSADSPIAFPQAMNMEMDHEPVRNNHPVIVTVRRYEDQMVPSMTSSLFRADDEETSVDIRNSVVDNRAEVPNDVNVTEDPRRNRLDVAVTQPARTNATPPQFNFVVGRRNSEDSTAESSSSTRERDGGVVPVWSPSSTNYSDQYVGDDNGIGTSSSYLQRHPQSHQLMNWQRLSQTG

SEQ ID NO: 13268 - protein, 680 aa, Lupinus angustifolius
MSSGGCSIVWFRRDLRVEDNPALSAAVRAGTVVALFIWAPEEEGQYQPGRVSRWWLKHSLAHLDSSLRSLGTSLITKRSTNSVSSLLDVVKSTGATQLFFNHLYDPLSLIRDHQAKEVLTSHGITVLSFNADLLYEPWDINDACGQPFTTFAAFWERCLSMPYDPDSPLLPPKKIIPGDVSRCMSDILVLEDELEKASNALLARAWSPGWSNANKALTTFINGPLLEYSKNRKKADSATTSFLSPHLHFGELSVKKVFHLVCIKQILWANEGNKAGEESVNLFLQSIGLREYSRYICFNHPNSHERPLLGQLKLFPWVVNEGYFKAWRQGRTGYPLVDAGMRELWATGWLHDRIRVVVSSFFVKVLQLPWRWGMKYFWDTLLDADLESDALGWQYISGSLPDGRELDRIDNPQFEGYKFDPNGEYVRRWLPELARLPTEWIHHPWNAPEAVLEAAGVELGSNYPLPIVGIDAAETRLEEALSEMWRLEAASRAVTENGTEEGLGDSSESTAVAFPQDIQMEESDEPARNNSPPLARHYQDQMVPSITSSLTRVEEEVTSDIRNSAEQSRAEVPINVNTRQNARDALNERMLQTAQRNAQLHYNSGMHMRNAAEDSAVESSSISRRRERDGGVVPEWSPSASSYSEQLVGDENGIASSSSYLQRHPQSHQLLNWRGLPQTG

SEQ ID NO: 13269 - protein, 682 aa, Sesamum indicum
MSGSGCSIVWFRRDLRVEDNPALAAGVRSGAVVALFIWAPEEEGHYYPGRVSRWWVKQSLAHLDSSLRSLGTSLVTKRSTDSVSCLLQVIKSTGATQLFFNHLYDPISLVRDHRAKEVLTAEGVAVRSFNADLLYEPWEVHDEEGRPFTTFTGFWEKCLSMPYDPEAPLLPPKRIIPGDVSRCPADTLVFEDESEKGSNALLARAWSPGWSNADKALTTFLNGPLIEYSKNRRKADSATTSFLSPHLHFGEISVRKVFHLVRIKQVLWANEGNVAGEESVNLFLKSIGLREYSRYMSFNHPYSHERPLLGHLKYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEYVRRWLPELARLPTEWIHHPWNAPESVLQAAGIELGSNYPLPIVEIVAAKARLQEALSQMWQHEAASRAAIENGMEEGLGDSSESTPIAFPSETHMEMDNEPIRNNPTNNIIRHYEDQMVPSMTSSFLRVEDEETSIELRNSVDNSRAEVPSNINVTEEPRREVHGHAIMQADRTNDAFPHTNFSRARRNSEDSTAESSSSSRRERDGGVVPVWSPSSSSYSDQFPGEDNGIGTSSSYLQRHPQSHQLLNWRRLSQTG

SEQ ID NO: 13270 - protein, 517 aa, Gossypium hirsutum
MPFDPEAPLLPPKRITSGDVLTCTTDVLVFEDELEKGSNALLARAWSPGWSNADKALTTFINGPLIEYSKNRRKADSATTSFLSPHLHFGEVSVRKVFHLVRMKQVLWANEGNKAGEESVNLFLKSIGLREYSRYLSFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEYVRRWLPELARLPTDWIHHPWNAPESVLQAAGIELGSNYPLPIVGIDAAKSRLQEALSEMWQLEAASRAAIENGTEEGLGDSSESVPFAFPQDIQMEENIEPARNNAPATTRRYEDQMVPSITSSLLRGEHEESSLYLRTSAEDSRAEVPGTVNINREQRRDTLNQAIPETARSLQLNFPIGLRNAEDSTAESSSSSRRERDGGVVPVWSPPSSSYPEQFIGEESGIGASSSFLQGHPQSHQIINWRRLSQTG

SEQ ID NO: 13271 - protein, 673 aa, Panax ginseng
MSAGGCNIVWFRRDLRVEDNPALAAGVRAGAVIAVYIWAPEEDGHYYPGRVSRWWLKQSLSQLDSSLRSLGTTLITKRSTDSVSSLLEVIKSTGATQVFFNHLYDPLSLVRDHRTKEVLTAQGIAVRSFNADLLYEPWEVLDDVGHPFTTFTAFWNKCLSMPYDPESPLLPPKRIISGDVSRCPSDTLVFEDESEKGSNALLARAWSPGWNNADKALTTFINGPLIEYSKNRRKADSATTSFLSPHLHFGEVSVRKVFHLVRLKQVLWANEGNQAGEESVNLFLKSIGLREYSRYISFNHPYSHEKPLLVHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEFVRRWLPELARLPTEWIHHPWNAPPIVLQAAGIELGSNYPLPIIEIDAAKSRLEQALTEMWQQEAASRAVIENGTEEGLGDSSDSASIAFPQDMEEDHGTFRNNPTTTTIRRYEDQMVPSMTASLVRGQEEDTSSDLRVGNGRAEVPINVNMDQEPRTEIFNQPIAQTAQTNNILPRFNIAIGLRDAEDSTAESSSSSVKRERDGGVVPVWSPSASSYSEQYVNEENSYLQRHPQSHQVMNWRRLSQTG

SEQ ID NO: 13272 - protein, 680 aa, Euphorbia peplus
MPGGCSIVWFRRDLRVEDNPALAAGVRAGSVIAVFIWAPEEEGHYYPGRVSRWWLKQSLAHLDSSLKTLGCKLMTKRSSDSVAALLDVVKTTGATQIFFNHLYDPLSLVRDHRAKEVLTGKGIAVRSFNADLLYEPWDINDAQGRPFTTFAGFWERCLSMPYDPESPLLPPKRIVAGDTSRCPADTLIFEDESEKGSNALLSRAWSPGWSNADKALTTFVNGPLIEYSKNRRKADSATTSFLSPHLHFGEVSVRKVFHLVRIRQVLWANEGNKAGEESVNLFLKSIGLREYSRYMSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDSRDFDRIDNPQFEGYRTDPNGEYVRRWLPELARLPTEWIHHPWNAPESVLQAAGIELGSNYPLPIVGIEAAKVRLQEALAEMWQLEAASRAAIENGTEEGLGDSADSAPIAFPRDILMEENHEPVRNIPPATVRRYEDQMVPSMTCSLIRAEEEETSSDLRNAAEDGRAEVPRNLNGNQEQMRETLNPAVTQTFRADNNGMHFNLTGGPAHTEDSTAESSSSGSRRERDGGIVPVWSPPSASYSEQYGGDDNGMGASSYLPRHSQAHQVVNWRRLSQTG

SEQ ID NO: 13273 - protein, 685 aa, Cannabis sativa
MSGGGCSIVWFRRDLRVEDNPALAAGVRAGAVIAVFVWAPEEEGHYYPGRVSRWWLKQSLAHLDFSLRSFGTSLITKRSADSVSSLLEVVKSTGAKQILFNHLYDPLSLVRDHRAKEVLTSQGIVVRSFNADLLYEPWEVNDDQGRPFTTFTSFWERCLSMPYDPESPLLPPKRIISGDVSRCRPDTLVFEDDSEKGSNALLARAWSPGWSSADKALTNFINGPLIEYAKNHKKADSATTSLLSPHLHFGEVSVRKVFHLVRIKQVLWANEGNKAGEESVNLFLKSIGLREYSRYMSFNHPYSHERPLLGHLKFFPWVVNEDYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPHGEYVRRWLPELSRLPTEWIHHPWNAPESVLQAAGIELGLNYPLPIVGIDAAKARLEEALSEMWEQEAASRAAIENGTEEGLGDSSDNNDGVIAFPQDIQMEENREPPRNNPPPPTTRHYEDQMVPSMTTSLFRVDEEESSVDFRTSAVDSRAEVPTNVVVTQERRSEVLNRGPVQTITQPQYNPTAMQYVAEDSTAESSSTTRRERDGGVVPVWSPSATSYSEQFVSEENGIGASSSYLQRHPQSHQIINWRRLSQTGCELFS

SEQ ID NO: 13274 - protein, 682 aa, Olea europaea
MSGGRCSIVWFRRDLRVEDNPALAAGVRAGAIVAVFIWAPEEEGPYYPGRVSRWWLKQSLAHLDTSLRTLGTSLVTKRSNDSLSSLVEVVKSTGATQLFFNHLYDPISLVRDHRAKEVLTAQGVAVRSFNADLLYEPWEVHDGEGRLFTTFSAFWDRCLSMLYDPEAPLLPPKRIISADVSRCPSDTLVFEDESEKGSNALLARAWSPGWSNADKALATFINGPLIEYSMNRRKADSATTSFLSPHLHFGEVSVRKVFHHVRMKQVLWANEGNKAGEESVNLFLKSIGLREYSRYMSFNHPYSHERPLLGHLKYFPWVVDESYFKAWRQGRTGYPLVDAGMRELWATGWLHDRIRVVVSSFFVKVLLLPWRWGMKYFWDTLLDADLESDALGWQYISGTLPDGRELDRIDNPQFEGYKFDPNGEYVRRWLPELSRLPTEWIHHPWNAPESVLQAAGIELGSNYPSPIVEMDAAKARLQEALSQMWQNEAASRAAIENGMEEGLGDSSEYAPIAFPEDTQMETDHEPVRNNPVNTVIRRYEDQMVPSMTSSFVRVDDEATSIDLRNSADDSRAEVPTNVNVNATEEPRETHGHDVVQTVRTVNTFPQFNFAMGQRDSEDSTAESSSGSRREREGGVVPVWSPSSSNYSDQFAGEDNGIGTGSYLQRHPQSHQLVNLRRLSQTG

SEQ ID NO: 13275 - protein, 679 aa, Solanum phureja
MSGGGCSIVWFRRDLRVEDNPALAAGVRAGAVIAVFIYAPEEEGHYYPGRVSRWWLKQSLAYLNSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAAEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNHAAARAAIENGMEEGHGDSADSLIAFPQAMHMEMDHEPVRNNPVIVTVRRYEDQMVPSMTSSLFRAEDEENSVDIRNSVVESRAEVPTDINVAEGHRRDTHDQAVMQTARTNATPHFNFAVGRRNSEDSTAESSSSTRERDGGVVPTWSPSSTNYSDQYVGDDNGIGTSSSYLQRHPQSHQLMNWQRLSQTG

SEQ ID NO: 13276 - protein, 673 aa, Panax ginseng
MSAGGCNIVWFRRDLRVEDNPALAAGVRAGAVIAVYIWAPEEEGHFYPGRVSRWWLKQSLSQLDSSLRSLGTTLITKRSTDSVSSLLEVIKSTGATQVFFNHLYDPLSLVRDHRTKEVLTAQGIAVHSFNADLLYEPWEVLDDVGHPFTTFTAFWNKCLSMPYDPESPLLPPKRIISGDVSRCPSDTLVFEDESEKGSNALLARAWSPGWNNADKALTTFINGPLIEYSKNRRKADSATTSFLSPHLHFGEVSVRKVFHLVRLKQVLWANEGNQAGEESVNLFLKSIGLREYSRYISFNHPYSHEKPLLVHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEFVRRWLPELARLPTEWIHHPWNAPPPVLQAAGIELGSNYPLPIIEIDAAKSRLEQALTEMWQQEAASRAVIENGTEEGLGDSSDSASIAFPQDMEEDHGTFRNNPTTTTIRRYEDQMVPSMTASLVRGQEEDTSSDLRLGNGRAEVPINVNMDQEPRTEIFNQPIAQTAQTNNILPRFNIAIGLRDAEDSTAESSSSSVKRERDGGVVPVWSPSASSYSEQYVNEENSYLQRHPQSHQVMNWRRLSQTG

SEQ ID NO: 13277 - protein, 673 aa, Panax ginseng
MSAGGCNIVWFRRDLRVEDNPALAAGVRAGAVIAVYIWAPEEEGHFYPGRVSRWWLKQSLSQLDSSLRRLGTTLITKRSTDSVSSLLEVIKSTGATQVFFNHLYDPLSLVRDHRTKEVLTAQGIAVRSFNADLLYEPWEVLDDVGHPFTTFTAFWNKCLSMPYDPESPLLPPKRIISGDVSRCPSDTLVFEDESEKGSNALLARAWSPGWNNADKALTTFINGPLIEYSKNRRKADSATTSFLSPHLHFGEVSVRKVFHLVRLKQVLWANEGNQAGEESVNLFLKSIGLREYSRYISFNHPYSHEKPLLVHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEFVRQWLPELARLPTEWIHHPWNAPPLVLQAAGIELGSNYPLPIIEIDAAKSRLEQALTEMWQQEAASRAVIENGTEEGLGDSSDSASIAFPQDMEEDHGTFRNNPTTTTIRRYEDQMVPSMTASLVRGQEEDTSSDLRVGNGRAEVPINVNMDQEPRTEIFNQPIAQTAQTNNILPRFNIAIGLRDAEDSTAESSSSSIRRERDGGVVPVWSPSASSYSEQYVNEENSYLQRHPQSHQVMNWRRLSQTG

SEQ ID NO: 13278 - protein, 673 aa, Panax ginseng
MSAGGCNIVWFRRDLRVEDNPALAAGVRAGAVIAVYIWAPEEEGHFYPGRVSRWWLKQSLSQLDSSLRRLGTTLITKRSTDSVSSLLEVIKSTGATQVFFNHLYDPLSLVRDHRTKEVLTAQGIAVRSFNADLLYEPWEVLDDVGRPFTTFTAFWNKCLSMPYDPESPLLPPKRIISGDVSRCPSDTLVFEDESEKGSNALLARAWSPGWNNADKALTTFINGPLIEYSKNRRKADSATTSFLSPHLHFGEVSVRKVFHLVRLKQVLWANEGNQAGEESVNLFLKSIGLREYSRYISFNHPYSHEKPLLVHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEFVRQWLPELARLPTEWIHHPWNAPPPVLQAAGIELGSNYPLPIIEIDAAKSRLEQALTEMWQQEAASRAVIENGTEEGLGDSSDSASIAFPQDMEEDHGTFRNNPTTTTIRRYEDQMVPSMTASLVRGQEEDTSSDLRVGNGRAELPINVNMDQEPRTEIFNQPIAQTVQTNNILPRFNIAIGLRDAEDSTAESSSSSIRRERDGGVVPVWSPSASSYSEQYVNEENSYLQRHPQSHQVMNWRRLSQTG

SEQ ID NO: 13279 - protein, 681 aa, Citrullus lanatus
MSGGGCSIVWFRRDLRVEDNPALTAAVRAGAVVAVFIWAPEEEGHYYPGRVSRWWLKQSLAHLDSSLRSLGTFLLTKRSTNTISALLDVVKATGASQLFFNHLYDPLSLIRDHQAKEVLSAQGIGVRSYNADLLYEPWDVKDANGNPFTTFAGFWERCLSMPCDPEAPLLPPKRIISGDASRCPCDTLVFEDESEKGSNALLARAWSPGWSNADKALTTFINGPLLEYSKNRRKADSATTSFLSPHLHFGEVSVRKVFHLVRMKQVLWANEGNKAGDESVNLFLKSIGLREYSRYMSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDSREFDRIDNPQLEGYKFDPNGEYVRRWLPELSRLPTEWIHHPWNAPESVLQAAGIELGSNYPLPIVGLDAAKARLEEALSEMWQQEAASRAAIENGTEEGLGDSSESIPIAFPQDIAMEEEDLEPARMNAHTIRCYEDQMVPSMTSSVRLEDEPSLNIQSTAEDGRAEVPTNTNLPQEPTRDAVNPRVLPTALTQTRRPYTAGIALRTSVEDSTAESSSSSDVRRERDGGVVPVWSPPSSSYTEQFVVDENGIGTSSSFLQGHQQTHQIINWRRLSQTG

SEQ ID NO: 13280 - protein, 640 aa, Panax ginseng
MSAGGCNIVWFRRDLRVEDNPALAAGVRAGAVIAVYIWAPEEEGHFYPGRVSRWWLKQSLSQLDSSLRSLGTTLITKRSTDSVSSLLEVIKSTGATQVFFNHLYDPLSLVRDHRTKEVLTAQGIAVRSFNADLLYEPWEVLDDVGHPFTTFTAFWNKCLSMPYDPESPLLPPKRIISGDVSRCPSDTLVFEDESEKGSNALLARAWSPGWNNADKALTTFINGPLIEYSKNRRKADSATTSFLSPHLHFGEVSVRKVFHLVRLKQVLWANEGNQAGEESVNLFLKSIGLREYSRYISFNHPYSHEKPLLVHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPNGEFVRQWLPELARLPTEWIHHPWNAPPPVLQAAGIELGSNYPLPIIEIDAAKSRLEQALTEMWQQEAASRAVIENGTEEGLGDSSDSASVAFPQDMEEDHGTFRNNPTTTTIRRYEDQMVPSMTASLVRGQEEDTSSDLRVGNGRAEVPINVNMDQEPRTEIFNQPIAQTVQTNNILPRFNIAIGLRDAEDSTAESSSSSIRRERGGGVVPSMVSLSF

SEQ ID NO: 13281 - protein, 378 aa, Cucumis melo
MKDLFLGILNSSPGLWMKAIFKAWRQGRTGYPLVDAGMRELWATGWLHDRIRVVVSSFFVKVLQLPWRWGMKYFWDTLLDADLESDALGWQYISGTLPDSREFDRIDNPQLEGYKFDPNGEYVRRWLPELSRLPTEWIHHPWNAPESVLQAAGIELGSNYPLPIVGLDAAKARLEEALSEMWQQEAASRAAIENGTEEGLGDSSESIPIAFPQDIAMDEEDIEPARVNAHTVRCYEDQMVPSMTSSVRLEDESSLNIQSTAEDGRAEVPTNANLPQEPARDAVNPRAMPTAPTQTRLPYTAGIALRTSVEDSTAESSSSSDVRRERDGGVVPVWSPPSSSYTEQFVVDENGIGTSSSFLQGHQQTHQIINWRRLSQTG

SEQ ID NO: 13282 - protein, 681 aa, Cucumis sativus
MSGGGCSIVWFRRDLRIEDNPALTAAVRAGAVVVVFIWAPEEEGHYYPGRVSRWWLKQSLAHLDSSLRSLGTYLLTKRSTNTISALLDVFKATGASHLFFNHLYDPLSLIRDHRVKEVLSAQGIRVRSYNADLLYEPWDVKDANGNPFTTFAGFWERCLSMPCDPEAPLLPPKRIISGDASRCPCDTLVFEDESEKGSNALLARAWSPGWSNADKALTTFINGPLLEYSKNRRKADSATTSFLSPHLHFGEVSVRKVFHLVRMKQVLWANEGNKAGEESVNLFLKSIGLREYSRYMSFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDSREFDRIDNPQLEGYKFDPNGEYVRRWLPELSRLPTEWIHHPWNAPESVLQAAGVELGSNYPLPIVGLDAAKARLEEALSEMWQQEAASRAAIENGTEEGLGDSSESIPIAFPQDIAMDEEDIEPARMNAHTVRCYEDQMVPSMTSSVRLEDESSLNIQSTAEDGRAEVPTNANLPQEPARDAVNPRAMPTAPTQTRRPYTAGIALRTSVEDSTAESSSSSDVRRERDGGVVPVWSPPSSSYTEQFVVDENGIGTSSSFLQGHQQTHQIINWRRLSQTG

SEQ ID NO: 13283 - protein, 681 aa, Tripterygium wilfordii
MAGGGCSIVWFRRDLRVEDNPALLAGVRAGAVVAVFIWSPEEEGHYNPGRVSRWWIKQSLAHLESSLRRLGTTLLTKRSTDSVATLLEIVKSTGATQLFFNHLYDPMSLVRDHRAKEALGAHGVAVQSFNADLLYEPWDVNDTQGCPFTTFTAFWERCLSMPYDPEAPLLPPKRIISGDVSRCPSDTLIFEDESEKGSNALLARAWSPGWSNADKALTTFLNGSLMEYSKNRRKADSATTSFLSPHLHFGEVSVRKVFHLVRIKQVLWANEGNKAGEESVNLFLKSIGLREYSRYMSFNHPYSLERPLLGHLKFFPWVVDEGYFKAWRQGRTGYPLVDAGMRELWATGWLHDRIRVVVASFFVKVLQLPWRWGMKYFWDTLLDADLESDALGWQYISGTLPDGREFDRIDNPQFEGYKFDPNGEYVRRWLPELARLPTEWIHHPWNAPDSVLQAGGIELGSNYPLPIVGIDAAKVRLQQALSEMWQREAASRAVMENGTEEGLGDSTESAPIAFPQDILMEENHEPAWNNPPATIRRYGDQMVPSITCSLVRVEEEENSVQNLAEDGRAEVPRDIHVNQEPTRDPLNQEVTQNLLGISTMPQFNITIALGDAEDSTAESSSSGSSQRERDGGVVPVWSPPTSSYPEHFVGDENGIATSSSYLERHPQSHQIMNWRRLSQTG

SEQ ID NO: 13284 - protein, 214 aa, Panax ginseng
MSAGGCNIVWFRRDLRVEDNPALAAGVRAGAVIAVYIWAPEEEGHFYPGRVSRWWLKQSLSQLDSSLRSLGTTLITKRSTDSVSSLLEVIKSTGATQVFFNHLYDPLSLVRDHRTKEVLTAQGIAVRSFNADLLYEPWEVLDDVGRPFTTFTAFWNKCLSMPYDPESPLLPPKRIISGDVSRCPSDTLVFEDESEKGSNALLARAWSTWVVNKC

SEQ ID NO: 13285 - protein, 672 aa, Vinca minor
MSGGCSIVWFRRDLRVEDNPALAAGVRSGAVIAVFIWAPEEEGHYHPGRVSRWWLKQSLSYLDSSLRSLGTALVTKRSTDSISSLLEVVKSTGATQLFFNHLYDPISLVRDHRAKEVLTAQGVAIRSFNADLLYEPWEVLDEEGRPFSTFSAFWERCLSMPYDPEAPLLPPKRIISGDVSRCPSDNLIFEDESEKGSNALLSRAWSPGWSNADKALTTFINGPLIEYSKNRRKADSATTSFLSPHLHFGEVSVRKVFHLVRIRQVLWANEGNSAGEESVNLFLKSIGLREYSRYMSFNHPQSHERPLLGHLKYFPWVVDENYFKAWRQGRTGYPLVDAGMRELWATGWLHDRIRVVVSSFFVKVLQLPWRWGMKYFWDTLLDADLESDALGWQYITGTLPDGREFDRIDNPQFECYKFDPNGEYVRRWLPELSRLPTEWIHHPWNAPESVLQAAGIELGSNYPLPIVGIDAAKVRLEEALSQMWQLESASRAAIENGTEEGLGDSEAGPIDFPQDMQIEVQQPIRNNPTTTVIRRYEDQMVPSITSSLFRIEDEETSTDVRNSAETSRAEVPITVNIIEEPPREPPFNNNTPPQFNFPVGRRNSEDSTAESSIGGSRRERDGSVVPVWSPSSSNFSDPFVNEDNSIGGASSSYLQRHPESHRMNWRRLSQTG

SEQ ID NO: 13286 - protein, 690 aa, Ricinus communis
MSGGGCSIVWFRRDLRVEDNPALAAGVRAGAVVAVFVWAPEEEGHYYPGRVSRWWLKQSLAHLDSSLRSLGTVLVSKRSTDSVSSLLEVVKSTGATQLFFNHLYDPISLVRDHRAKEVLTAQGIAVRSLTRICYMNPGPPPPPPPPPPPPPPPPPPPPPPPPPPPPPPPPCLSMPYDPEAPLLPPKRIISGDISRCPSDTLIFEDESEKGSNALLARAWSPGWSNANKALTTFINGPLIEYSKNRRKADSATTSFLSPHLHFGEVSVRKVLHLVRIKQVLWANEGNKAGEESVNLFLKSIGLREYSRYLSFNHPYSHERPLLGHLKFFPWIVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKFDPHGEYVRRWLPELARLPTEWIHHPWNAPESVLQAAGIELGSNYPLPIVGIDAAKVRLQEALSEMWQHEAASRAAIENGTEEGLGDSSESAPIAFPQDIQMEENLEPIRNNPPIPIRRYEDQMVPSMTSSLLRVEEEETSSDLRNAAEDSRAEVPRDVNVNQEQRRNLGVAQAFRSNNLPNVNILRGLPNTEDSTAESSSSTRRERDGGIVPVWSPPSTSYSEQFAGDENGIGTSSSYLQRHPQSHQIINWRRLSQTG

SEQ ID NO: 13287 - protein, 674 aa, Phaseolus vulgaris
MRGGGGCSIVWFRRDLRVEDNPALTAGVRAGAVVAVFIWAPEEEGQYYPGRVSRWWLKQSLAHLDSSLRNLGTRLITKRSTDTVSSLLEVLKFTGATQLYFNHLYDPLSLVKDHRVKEVLNAKGITVRSFNADLLYEPWDVNDVHARPFTTFAAFWDRCLNMPYDPDSPLLPPKRIIPGDVSRCPSDRLVFEDESEKASNALLARAWSPGWSNANKALTAFINGPLIEYSTNCRKADSATTSLLSPHLHFGELSVKKVFHLVRIKQLLWANEGNKASEESVNLFLKSIGLREYSRYISFHHPYSHERPLLGHLKFFPWVVNEAYFKAWRQGRTGYPLVDAGMRELWATGWLHDRIRVVVSSFFVKVLQLPWRWGMKYFWDTLLDADLESDALGWQYITGTLPDGREFDRIDHPQFEGYKFDPNGEYVRRWLPELARLPTEWIHHPWNAPESVLQAAGIELGSNYPLPIVGIDAAKTRLQEALSEMWQLEATSRAEVENGTEEGLGESSESIPAAFAQDTQMEETHEPVRNNPLPVARSFLDQMVPSITSTLLRVEDEETTSDLRNSAEESSAAEVPINVNAQQNAGGVTWNERILQSAHRNTQVQYNTTMELRNVAEDSAVESSSGTRRERDGGSVPVWSPPASSDSEQFVGDENGITNLFLAKASSVSPITEL

SEQ ID NO: 13288 - protein, 522 aa, Glycine max
MEVTKDPNSDFELELYTIPSSSRWFAWEEIHETERTAFKEYFDGNSITRTPKIYKEYRDFIINKYREEPSRRLTFTEVRKSLVGDVTFLHKAFLLLEHWGLINYGTAQPSSGADAAEEEEEHRKVRLEEGAPGGIRVAATPNSLKPMLLPRNGKSGVNASGASLKLPPLASYSDVYGDLIRQKEGNCGLCGHKCGSGHYRCTQDNFIICINCFKSGNYGEKRSTEDFVLSESSENSGKHDTVWTEAETLLLLESVLKHGDDWELVAQSVQTKTKLDCISKLIELPFGELMLGPAHRNVNINDANGIVNNAKQVQSSSSDNQEISKTKDQSPEFTNENEQNGDAVKESPSKRQRVASLSDSSSSLMNQVGLISNVVDPHITAAAADAAVSALCDEDLCPREIFDVDGEEGLEMERSSLSEIPLTLRVRAATATALGAAAARAKLLADQEDREIEHLVATIIEAQIDKMLQKVKHFDDLELLMEKEHAEMENKKDSILTERIDVLRRTFRSGVTRWKDYSYVKS

SEQ ID NO: 13289 - protein, 527 aa, Glycine max
MEVAKDPNSQADSDSELELYTIPSSSRWFAWEEIHETERAAFKEYFDGSSISRSPKIYKEYRDFIINKYREEPSRRLTFSEVRKSLVGDVTFLHKVFLFLEHWALINYGTAEDVEEDHCKVRFEEGAPSGIRVAATPNSLKPMLLPRNGKSAANATGASLKLPPLASYSDVYGDLIRQKEGNCALCAHQCGSGHYRCTQDNFIICANCFKSGNYGEKRSAEDFVFSESSENSVKHDTVWTEAETLLLLESVLKHGDDWELVAQSVQTKTKLDCISKLIELPFGELMLGPTHKNVNINGANGIMNNAKQVQSSSSDNQEISKTKDQTPELTNENEQNGDAVKESPSKRQRVAALSDSSSLLMNQVGLISNVVDPHITAAAADAAVSALCDEDLCPREIFDVEEDYSARALEGEEGLEMERSSLSEIPLTLRVRAATATALGAAAARAKLLADQEDREIEHLVATIIEAQIEKMLRKVKHFDNLELLMEKEHAEMENLKDSILTERIDVLRRTFRSGVTRWKDYSYAKS

SEQ ID NO: 13290 - protein, 524 aa, Cajanus cajan
MDDSDSELELYTIPSSSRWFAWDEIHETERTAFKEFFDGSSVSRTPKIYKEYRDFIINKYREEPSRRLTFTEVRKSLVGDVTFLRKAFLFLQNWGLINYGAPSAADAEGDVEDECRVRVEDGAPTGIRVAATPNSLKPMAGGRGAAKSGGSASGGSLKLPPLASYSDVYGDLIRQKEVKCGLCGDKCGSGHYRCSQDNFIICTNCFKSGNFGERRSAEDFVLSESSENSGKHDTVWTEGETLLLLESVLKHGDDWELVAQSVQTKTKLDCISKLIELPFGELMLGSAHRNVNSNSVNGIMNNAKQVQSSSADDQETSKTNDQCPELPNENEQNGDAVKESPSKRQRVAALSDSSSSLMNQVGLISTVVDPHITAAAADAAVSALCDENLCPREIFDVEEDEGLETERSSLSEMDHSCPKDGIPLTLRVRAATATALGAAAARAKLLADQEYREIEHLVATIIDAQIEKLLHKVKHFDDLELLMEKEHAEMENLKDSILTDRIDVLRRTFRSGITRWKDYSYVKS

SEQ ID NO: 13291 - protein, 243 aa, Vigna unguiculata
MEYTYSAEGAEAETYTSSSTTPSSAMRSSKKKANNNTRRFSDDQIKSLETMFETESRLEPRKKLQLARDLGLQPRQVAIWFQNKRARWKSKQLERDYGILQSNYNSLASRFEALKKEKQTLLIQLQKLNHLMQKPLEGGQSRTQVEAANSMDSESENGGTMKCEEEEKPSPSVERSEHVHGVLSDDDGSIKVEDFGLEDEHGLLNFGEHADDSLTSPEDWSAFESDGLLGQTTGDYQWWDFWS

SEQ ID NO: 13292 - protein, 238 aa, Glycine max
MEYTYSAGVEAETHTSSSTTPSRSKKRNNNTRRFSDEQIKSLETMFESESRLEPRKKLQLARELGLQPRQVAIWFQNKRARWKSKQLERDYGILQSNYNSLASRFEALKKENQTLLIQLQKLNHLMQKPMEPGQRCTQVEAANSMDSESENGGTMKCEAEGKPSPSMEISEHLLGVLSDDDTSIKVEDFGLEDEHGLLNFAKHVDGSLTSPEDWNAFESNDLLGQSTTDDYQWWDFWS

SEQ ID NO: 13293 - protein, 247 aa, Cajanus cajan
MEYTYSAEAETYTSSSTTPSTALRKKKNNNNNNNNNNNNNTRRFSDDQIKSLENMFETESRLEPRKKLQLARELGLQPRQVAIWFQNKRARWKSKQLERDYTILQTNYNTLASRFEALRKEKQTLLIQLQKLNHLMQKPLEPGEKCTQVEAANSVDSESEYGGTMKCEAEEKPSPSMERSEHVFGVLSDDDTSIKVENFGLEDEPGLLNFAEHADGSLTSPEDWGAFESNDLLGQSTSDYQWWDFWS

SEQ ID NO: 13294 - protein, 245 aa, Glycine max
MEYSQYTTYSAEGVEAETYTSSCTTPSRSKKRNNNNTRRFSDEQIKSLETMFESETRLEPRKKLQLARELGLQPRQVAIWFQNKRARWKSKQLERDYGILQSNYNTLASRFEALKKEKQTLLIQLQKLNHLMQKPMEPSQRCTQVEAANSMDSESENGGTMKCKAEGKPSPSSLERSEHVLGVLSDDDTSIKVEDFNLEDEHGLLNFVEHADGSLTSPEDWSAFESNDLFGQSTTDDYQWWDFWS

SEQ ID NO: 13295 - protein, 370 aa, Glycine max
MEVAQVLHMNGGVGDASYANNSLVQQKVICLTKPIREEAIRSLYCSTHPRSLAIADLGCSSGPNTLFVVSEFIKIVEKLCRELNHKSPEYKVFLNDLPGNDFNNIFKSLDSFKEKLCDEMESGIGPCYFSGVPGSFYGRVFPYQSLHFVHSSYSLQWLSKVPEGVDNNKGNVYIGSTSPKNVVRAYYEQFQRDFSLFLKCRAEELVEGGRMVLTFLGRRSDDPSSKDGCYIWELLATALSDMVLQGIIREEQLDTFNIPQYTPSPSEVKLEVLKEGSFAINRLEVSEVNWNALDEWNALDFESERSESLSDGGYNVAQCMRAVAEPMLISHFGEAIIEEVFCRYQQILAERMSKEKTKFINVTILLTRKA

SEQ ID NO: 13296 - protein, 370 aa, Glycine max
MEVAQVLHMNGGFGDASYANNSLLQRKVICLTKPIREEAIRSLYCSTHPRSLAIADLGCSSGPNTLFVVSEFIKIVEKLCRELNHKSPEYKVFLNDLPGNDFNNIFKSLDSFKEKLCDEMESGIGPCYFSGVPGSFYGRVFPYQSLHFVHSSYSLHWLSKVPEGVDNNKGNVYIGSTSPKNVVRAYYEQFQRDFSLFLKCRAEELVEGGRMVLTFLGRRSDDPSSKDGCYIWELLATALSDMVLQGIIREEQLDTFNIPQYTPSPSEVKLEVLKEGSFAINRLEVSEVNWNALDEWNALDFESERSESLSDGGYNVAQCMRAVAEPMLISHFGEAIIEEVFCRYQQILAERMSKEKTKFINVTILLTRKA

SEQ ID NO: 13297 - protein, 359 aa, Phaseolus vulgaris
MEVAQVLCMNGGVGDASYANNSLVQLKGICLTKSIREEAITSLYCSALPRSLAVADLGCSSGPNTLFVVSELIETVEKLCQQLNHKSPEYKVFLNDLSGNDFNNIFKSIDSFKEKLQNEMESGPCYFSGVPGSFYGRVFPSQSLHFVHSSYSLHWLSKVPEGVDNKGNIYIGRTSPTNVVRAYYDQFQRDFCLFLKCRAEELVEGGRMVLTFLGRSNEDPCSKNNLCYIWELMASALNDMVSQGMIKEEQVDSFNIPQYTPSPSEVELEVLNEGSFSINRLEVSEMNRDTLDFEPERFESIGDDVAQWMRALAEPMLVSHFGEDIIEEVFTRYKQILAHRLSKEKTQLISVTLLLTRKT

SEQ ID NO: 13298 - protein, 370 aa, Glycine max
MKVAHVLHMNGGVGDASYANNSLVQQKVICLTKPIREEAITSLYCNTVPRSLAVADLGCSSGPNTLFVVSEFIKIVDKLCRELNHESPEYKVFLNDLPGNDFNSIFKSLDSFKEKLRDEMESRIGPCYFYGVPGSFYGRVFPNQSLHFVHSSYSLQWLSKVPEGVDNNRGNVYIGSTSPTNVARAYYEQFQRDFSLFLKCRAEELVKGGRMVLTFLGRRSDDPSSKDGCYIWELMATALNDMVLQGIIKEEQLDTFNIPQYTPSPSEVKLEVLKEGSFAINRLEVSEVNWDAFDDWNALEFESERADSLSDGGYNVAQCMRAVAEPMLVSHFGEAIIEEVFSRYQQILADRMSKEKTKFTNVTILLTKKA

SEQ ID NO: 13299 - protein, 356 aa, Phaseolus vulgaris
MEVAQVLCMNGGVGDASYAKNSLVQLKGICLTKSIREEAITSLYCSALPRSLAIADLGCSSGPNTLFVVSELIETVEKLCRQLNHKSPEYKVFLNDLPGNDFNNIFKSIDSFKEKLQNEMESGPCYFSGVPGSFYGRVFPSQSLHFVHSSYSLHWLSKVPEGVDNKGNIYICRTSPSNVVRAYYDQFRRDFCLFLKCRAEEVVEGGRMVLTFLGRSNEDPCSKNNVCYIWELMASALNDMVSQGMIKEEQVDSFNIPQYTPSPSEVELEVLKEGSFSINLSELNWDTLDFEPERFESIGDDVAQWMRALAEPMLVSHFGEDIIEEVFTRYKQILAHRLSKEKTQLISVTLLLTRKT

SEQ ID NO: 13300 - protein, 370 aa, Glycine max
MKVAHVLHMNGGVGHASYANNSLVQQKVICLTKPIREEAITSLYCNTVPRSLAVADLGCSSGPNTLLVVSEFIKIVEKLCRELNHKSPEYKVFLNDLPGNDFNNIFKSLDSFKEKLRDEMESRIGPCYFYGVPGSFYGRVFPNQSLHFVHSSYSLQWLSKVPEGVDNNRGNVYIGSTSPTNVARAYYEQFQRDFSLFLKCRAEELVKGGCMVLTFLGRRSDDPSSKDGGYIWELMATALNDMVLQGIIKEEQLDTFNIPQYTPSPSEVKLEVLKEGSFAINRLEVSEVNWDAFDDWNALEFESERADSLSDGGYNVAQCMRAVAEPMLVSHFGEAIIEEVFSRYQQILADRMSKEKTKFTNVTILLTKKA

SEQ ID NO: 13301 - protein, 374 aa, Cajanus cajan
MEVAQVLHMNGGVGDASYANNSFVQQKVLCLTKPIREEAITSLYCNTLPRSLGIADLGCSSGPNTLFVVSECIKTVEKLCQQLNHKSPEYKVFLNDLPGNDFNNIFKSLDSFKEKLYHEMESRVGPCYFSGVPGSFYGRVFPNRSLHFVHSSYSLQWLSKVPEGVDNNKGNIYIGSTSPSNVVRAYYEQFQTDFSHFLKCRAEELVEGGRMVLTFLGRRSDDPSSKDGCYIWELMAKALNDMVLEGIIKEEQLDTFNIPQYTPSPSEVKLEVLKEGSFALSRLEVSEVNWNWNSIDDWNSTLDFEFDRSDESLGNGGYNVAQCMRAVAEPMLISHFGEAIIEEVFSRYQKILNDRISKEKTEFINVTVLLTRKA

SEQ ID NO: 13302 - protein, 252 aa, Glycine max
MKVAQVLHMNGGVGHASYGNNSLVQEKVICLTKPIREEAITSLYCNTVPRSLAVADLGCSSGPNTLLVVSEFIKIVEKLYRELNHKSPEYKVFLNDLPGNDFSNIFKSLDSFKEKLCDEMESGIGPCYFSGVPGSFYGRVFPNQSLHFVHSSYSLQWLSKVPEGVDNNRGNVYIGSTSPTNVARAYYEQFQRDFSLFLKCRAEELVKGGRMVLTFLGRRSDDPSSKDGGYIWELMATALNDMVLQGIIKKSS

SEQ ID NO: 13303 - protein, 370 aa, Glycine max
MKVAQVLHMNGGFGDASYANNSLLQRKVICLTKPIREEAIRSLYCNTVPRSLAVADLGCSSGPNTLLVVSEFIKIVEKLCRELNHKSPEYKVFLNDLPGNDFNNIFKSLDSFKEKLCDEMESRIGPCYFYGVPGSFYGRVFPNQSLHFVHSSYSLHWLSKVPEGVDNNRGNVYIGSTSPTNVARAYYEQFQRDFSLFLKCRAEELVKGGRMVLTFLGRRSDDPSSKDGCYIWELMATALNDMVLQGIIKEEKLDTFNIPLYTPSPSEVKLEVLKEGSFAINRLEVSEVSWNAHDEWNALEFESERSESLSDGGYNVAQCMRAVAEPMLVSHFGEAIIEEVFSRYQQILTDRMSKEQTKFINVTVLLTRKA

SEQ ID NO: 13304 - protein, 370 aa, Glycine max
MKVAQVLHMNGGVGHASYANNSLLQEKVICLTKPIREEAITSLYCNTVPRSLAVADLGCSSGPNTLLVVSEFIKIVEKLCRELNHKSPEYKVFLNDLPGNDFNNIFKSLDSFKEKLCDEMESRIGPCYFYGVPGSFYGRVFPNQSLHFVHSSYSLHWLSKVPEGVDNNRGNVYIGSTSPTNVARAYYEQFQRDFSLFLKFRAEELVKGGRMVLTFLGRRSDDPSSKDGGYIWELMATALNDMVLQGIIKEEKLDTFNIPLYTPSPSEVKLEVLKEGSFAINRLEVSEVNWNAFDDWNALEFESERSDTLSDGGYNVAQCMRAVAEPMLVSHFGEAIIEEVFSRYQQILTDRMSKEQTKFINVTVLLTRKA

SEQ ID NO: 13305 - protein, 154 aa, Glycine max
MEVAQVLHMNGGVGDASYANNSLVQEKVICLTKPIREEAITSLYCNTVPRSLAVADLGCSSGPNTLLFVSEFIKIVEKLCRELNHKSPEYKVFLNDLPGNDFNNIFKSLDSFKEKLCDEMESGIGPCYFSGVPGSFYGRVFPNQSLHFVHSMAI

SEQ ID NO: 13306 - protein, 154 aa, Glycine max
MKVAQVLHMNGGVGNASYANNSLVQEKVICLTKPIREEAITSLYCNTVPRSLAVADLGCSSGPNTLLFVSEFIKIVEKLCRELNHKSPEYKVFLNDLPGNDFNNIFKSLDSFKEKLCDEMESGIGPCYFSGVPGSFYGRVFPNQSLHFVHSMAI

SEQ ID NO: 13307 - protein, 374 aa, Cajanus cajan
MEVAQVLHMNGGVGDASYANNSFVQQKVLCLTKPIREEAITSLYCNTLPRSLGIADLGCSSGPNTLFVVSECIKTVEKLCQQLNHKSPEYKVFLNDLPGNDFNNIFKSLDSFKEKLYHEMESRVGPCYFSGVPGSFYGRVFPNRSLHFVHSSYSLQWLSKVPEGVDNNKGNIYISSTSPSNVVRAYYEQFQTDFSHFLKCRAEELVEGGRMVLTILGRRSDDPSSKDGCYIWELMAKALNDMVLEGIIKEEQLDTFNIPQYHPSPSEVKLEVFKEGSFVMNRLEVSEVNWNRNAIDDWNSTRDFEFERPYESLGDGGYNMARCMRAVTEPMLISHFGEAIIAELFSRYRQILTDCMSKEKTEFINVTILLTRNA

SEQ ID NO: 13308 - protein, 371 aa, Lotus japonicus
MEVTQVLHMNGGVGEASYANNSLVQQKVISLTKPIREEAITSLYCTTFPRSLAIADMGCSSGPNTLFVVSEIIKVVEKLCRELNRKSPEYKVFLNDLPGNDFNNIFKSLDSFKEKLSDEMESDIMGPCYFYGVPGSFYGRVFPNQSLNFVHSSYSLQWLSKVPEGAENNKDNIYISRTSPSNVVKAYYEQFQRDFSVFLKCRAEELVEGGRMVLTFLGRKSDNPCSKECCYIWELMAKALNDMVMQGIIKEDQVTTFNIPQYTPSPLEVKWEVLKEGSFAINRLEVSEVNWNAMDECNVFEFESEMNESLSDSGYNVAQCMRAVAEPLLVNHFGEAIIEKVFSRYQEILADRMSKEKTKFVNVTILLTRKG

SEQ ID NO: 13309 - protein, 374 aa, Cajanus cajan
MEVEKVLHMNGGIGDASYANSSFVQQKVLCLTKSIREEAITSLYCNTLPRSLEIADLGCSSGPNTLFVVSEFIKTVEKLCQKLNHKSPEYKVFLNDLPGNDFNNIFKSLDSFKEKLYHEMESRVGPCYFSGVPGSFYGRVFPNRSLHFVHSSYSLQWLSKVPEGVDNNKGNIYISSTSPSNVVRAYYEQFQTDFSHFLKCRAEELVEGGRMVLTMLGRRSYDPSSKDGCYIWELMAKALNDMVLEGIIKEEQLDTFNIPQYHPSPSEVKLEVFKEGSFVMNRLEVSEVNWNRNAIDDWNSTRDFEFERPYESLGDGGYNMARCMRAVTEPMLISHFGEAIIAELFSRYRQILTDCMSKEKTEFINVTILLTRNA

SEQ ID NO: 13310 - protein, 371 aa, Lotus japonicus
MEVTQVLHMNGGVGEASYANNSLVQQKVISLTKPIREEAITSLYRSTFPRSLAIADMGCSSGPNTLFVVSETIKVVEKLCQELNLKSPEYKVFLNDLPGNDFNNIFKSLDNFKEKLSDEVESRIIGPCYFYGVPGSFYGRVFPNQSLHFVHSSYSLHWLSKVPEAVDNNKGNIYISSTSPSNVVKAYYKQFQGDFSVFLKCRAEELVEGGHMVLTFLGRRSDNPCSKECCYIWELLATALNDMVMQGIIKEDQVTTFNIPLYTPSSLEVKLEVLKEGSFAINRLEVSEVNWNAMDERNAFEFESEMNESLSDAGYNVAQSVRAVAEPMLVNHFGEAIIENVFSRYQEILDDRMSKEKTKFVNVTILLTRKG

SEQ ID NO: 13311 - protein, 242 aa, Glycine max
MPSAQDPFYVVKQEIQESIDKLQSTFHQWEKTADAGERSNLSKEVLGSCESIEWQVDELDKAISVASRDPSWYGIDEVEVENRRKWTSDARTQVSTAKKAVQAGKGLNNASLNGMHKELMRLPSSHQTTSNQYAAQDNDDFIESESDRQMLLIKRQDEELDELSLSVQRIGGVGLTIHEELLAQEKIIDELGNEMDSTSNRLDFVQKKVAMVMKKASAKGQIMMILGLLALFIFLFILVFFT

SEQ ID NO: 13312 - protein, 244 aa, Cajanus cajan
MPSAQDPFYVVKEEIQESIDKLQSAFHQWENTAEAGERSRLSKEVVASCESIEWQVDELDKAISVASRDPSWYGIDEVELESRRRWTSDARTQVSTTKKAAAAGGSNITNNATLNGMHRELMRLPNSYQAASDQYAARDNDDFIESESDRQMLLMKKQDEELDELSLSVQRIGGVGLTIHEELLSQEKIIDELGNEMESTSNRLDFVQKKVAMVMKKASAKGQIMMILGLLALFIFLFILVFFT

SEQ ID NO: 13313 - protein, 242 aa, Glycine max
MPSAQDPFYVVKQEIQESIDKLKSTFHQWENTADVGERSSLSKEVLASCESIAWQVDELDKAISVAARDPSWYGIDEVEVENRRKWTSDARTQVSKAKRTVEAGKGSNNASLSGMHRELMRLPSSHQTTSNQYAAQDNDDFIESESDRQMLLIKRQDEELDELSLSVQRIGGVGLTIHEELLAQEKIIDELGNEMDGTSNRLDFVQKKVAMVMKKASAKGQIMMILGLLAMFIFLFILVFFT

SEQ ID NO: 13314 - protein, 242 aa, Glycine max
MPSAQDPFYVVKQEIQESIDKLKSTFHQWENTADVGERSSLSKEVLASCESIAWQVDELDKAISVAARDPSWYGIDEVEVENRRKWTSDARTQVNKAKRTVEAGKGSNNASLSGMHRELMRLPSSHQTTSNQYAAQDNDDFIESESDRQMLLIKRQDEELDELSLSVQRIGGVGLTIHEELLAQEKIIDELGNEMDGTSNRLDFVQKKVAMVMKKASAKGQIMMILGLLAMFIFLFILVFFT

SEQ ID NO: 13315 - protein, 246 aa, Arachis hypogaea
MPSAQDPFYVVKEEIQDSIDKLQSSYHQWESTSDGGDRTNLSKEVLTACESIEWQVDELDKAISVASRDPSWYGIDEVEIENRRRWTSSARTQVRTMKNSVEAGKASNVTNHASVNGMRRELMRLPNSHQADTSNQYTANHNDDFIESESDRQMLLMKKQDEELDELSLSVQRIGGVGLTIHEELLAQEKIIDELGNEMDSTSNRLDFVQKKVAMVMKKASAKGQIMMILGLLALFIFLFILVFFT

SEQ ID NO: 13316 - protein, 246 aa, Lupinus angustifolius
MPSAQDPFYVVKEEIQDSIDKLQSTFHQWENTPDAGERSHLSKEVLTGCESIEWQVDELDKAIAVASRDPSWYGIDELEIENRKRWTSSARTQVRTVKKAAEAENGPNKTNHASVNGMHRELMRHPNSHQSDISNNYAAQDSDDFIESESDRQMLLIKRQDEELDELTLSVQRIGGVGLTIHEELLAQEKIIDELGSEMDSTSNRLDFVQKKVGMIMKKASAKGQIMMILGLLALFIFLFILVFFT

SEQ ID NO: 13317 - protein, 246 aa, Lupinus angustifolius
MPSAQDPFYVVKAEIQESIDKLQSTFRQWENALDAGERVHLSKEVLAGCESIEWQVDELDKAIAVASQDPSWYGIDEVELESRRRWTSSARTQVGTVKKAVEAGKGSSTASHASVNAMHQELMRLPNSRETDTYNQYAAQDNDDFIQSESDRQMLLIKRQDEELDELSLSVQRIGGVGLTIHEELIGQERIIDELGSEMDSTSNRLDFVQKKVAMVMKKASAKGQIMMILGLFALFIFLFILVFFT

SEQ ID NO: 13318 - protein, 245 aa, Cicer arietinum
MPSAQDPFYVVKEEIQDSIDRLQSNFHQWENTSDTGEHLHLSKEVIAACGSIEWQVDELDKAISVASRDPSWYGIDDVEIENRRRWTSNARTQVRTVKKTVESGKGSNTTSHASINGMHKELMRLPDSHQSTSNKYTAGDNDDFIESESDRQMLLIKRQDEELDELSLSVQRIGGVGLTIHEELLGQEKILDELGNEMDSTSNRLDFVQKRVAMVMKKASVKGQIMMILGLLALFIFLFILVFFT

SEQ ID NO: 13319 - protein, 241 aa, Lotus japonicus
MPSAQDPFYVVKEEVQDSIDKLQTTFHQWENTSDAGERERLSKEVLAGCESTEWQVDELDKAISVASRDPSWYGIDEVEIENRRRWTTNARTQVRTTKKAVEAGKGSNTSINGMRKELMRLPDSHQTTSNQYAAQDSDDFIDSESDRQMLLIKKQDEELDELTLSVQRIGGVGLTIHDELVAQERIIDELGNEMDSTTNRLDFVQKKVAMVMKKASAKGQFLMILGLLALFIFLFILVFFT

SEQ ID NO: 13320 - protein, 247 aa, Medicago truncatula
MPSAQDPFYVVKEDIQDSIDRLQSNFHQWENTSDTGEHLNLSKEVLAACGSIEWQVDELDKAISVASRDPSWYGIDEVEIENRRRWTSNARTQVRTIKRTVEAGKGSNPTTHASISGMHRELMRLPDSHQSTSKSNQYASGDNDDFIESESDRQMLLIKQQDEELDELSLSVQRIGGVGLTIHEELLGQEKILDELGNEMDSTSNRLDFVQKRVAMVMKKASAKGQMMMICGLLALFIFLFILVFFT

SEQ ID NO: 13321 - protein, 1168 aa, Glycine max
MAASSERWIDRLQYSSLFWPPPPDGQQRKDQIAAYVEYFIQFTSEQFADDIAELIRNRYPSKDILLFDDVLATFVLHHPEHGHAVVLPIISCIIDGTLVYDKASPPFASFISSVCPKIENEYSEQWALACGEILRILTHYNRPIYKTERQSGETERSTSGSHATTSEPGKSGHNSLTQQEKKPIRPLSPWITDILLSSPVGIRSDYFRWCSGVMGKYAAGELKPPSTASSRGSGKHPQLVPSTPRWAVANGAGVILSVCDDEVARNETTTLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVDGVEVQHEPLGGYISSYKKQIEVPAAEASIEATAQGIASMLCAHGPEVEWRICTIWEAAYGLIPTSSSAVDLPEIIVATPLQPPILSWNLYIPLLKVLEYLPRGSPSEACLMKIFAATVEAILQRTFPPESTREQNRKSKYLAGIGSASKNLAMAELRTMVHSLFLESCASVELASRLLFVVLTVCVSHEAQFSGSKRPRGEDNYSAEDIIEDLQTSENQKVSKNRKLKKQGPVAAFDSYVLAAVCALACELQLFPLISCGNNRLASNNVQDIAKPVRLNGSSHELQNGLDSAMRHTHRILAILEALFSLKPSSVGTPWSYSSNEIVAAAMVAAHVSELFRRSKTCMHALSVLIRCKWDNEIHSRASSLYNLIDIHSKAVASIVNKAEPLEATLIHVPIWKDSLVCVGVKRQNQCESSSCFAPGQTSVVPSEDSFPSKVDHNSQKTPCSKDASDYTLGKGVTGFSLDASDLANFLTMDRHIGLNCNGQIFLRSTLAEKQELCFSVVSLLWHKLIASPETQPCAESTSAQQGWRQVVDALCNVVSASPTKAATAVVLQAERELQPWIAKDDDLGQKMWRINQRIVKLIVELMRNHETSESLVIVASSSDLLLRATDGMLVDGEACTLPQLELLEATARAVQPVLEFGESGLAVADGLSNLLKCRLSATIRCLSHPSAHVRALSISVLRDILHTGSIRCSPKPRRLNGTHNPSYQYFNLDVIDWQADIEKCLTWEAHSRLSNGLSINFLDTAAKELGCTISM

SEQ ID NO: 13322 - protein, 1170 aa, Glycine max
MAASSERWIDRLQYSSLFWPPPPDGQQRKDQIAAYVEYFIQFTSEQFADDIAELIRNHYPSKDILLFDDVLATFVLHHPEHGHAVVLPIISCIIDGTLVYDKASPPFASFISSVCPKIENEYSEEWALACGEILRILTHYNRPIYKTERQSGETERSTSGSHATTSEPGKSGHNSLTQHEKKPIRPLSPWITDILLASPVGIRSDYFRWCSGVMGKYAAGELKPPSTASSRGSGKHPQLVPSTPRWAVANGAGVILSVCDDEVARNETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVDGVEVQHEPLGGYISSYKKQIEVPAAEASIEATAQGIASMLCAHGPEVEWRICTIWEAAYGLIPTSSSAVDLPEIIVATPLQPPVLSWNLYIPLLKVLEYLPRGSPSEACLMKIFAATVEAILQRTFPPESTREQNRKSKYLAGIGFGSASKNLAVAELRTMVHSLFLESCASVELASRLLFVVLTVCVSHEAQFSGSKRPRGEDNYSSEDIIEDLQTSENQKESKNRKLKKQGPVAAFDSYVLAAVCALACELQLFPLISRGNNHLASNKVQDIAKPVRLNGSSHELRNGLDSAVRHTHRILAILEALFSLKPSSVGTPWSYSSNEIVAAAMVAAHVSELFRRSKACMHALSVLIRCKWDNEIHSRASSLYNLIDIHSKAVASIVNKAEPLEATLIHAPIRKDSLVCVGVKRQNQCESSSCFDAGRTSVVPSEDSFPSKLDHNSNKTPCPKGASDYTLGKGVTGFSLDASDLANFLTMDRHIGLNCNGQIFLRSTLAEKQELCFSVVSLLWHKLIASPETQPCAESTSAQQGWRQVVDALCNVVSASPTKAATAVVLQAERELQPWIAKDDDSGQKMWRINQRIVKLIVELMRNHETAESLVIVASSSDLLLRATDGMLVDGEACTLPQLELLEATARAVQPVLEFGESGLAVADGLSNLLKCRLSATIRCLSHPSAHVRALSISVLRDILHTGSIRCSPKPRRLNGTHNPSYQYFNLDAVDWQADIEKCLTWEAHSRLSNGLSINFLDIAAKELGCTISM

SEQ ID NO: 13323 - protein, 1170 aa, Glycine max
MAASSERWIDRLQYSSLFWPPPPDGQQRKDQIAAYVEYFIQFTSEQFADDIAELIRNHYPSKDILLFDDVLATFVLHHPEHGHAVVLPIISCIIDGTLVYDKASPPFASFISSVCPKIENEYSEEWALACGEILRILTHYNRPIYKTERQSGETERSTSGSHATTSEPGKSGHNSLTQHEKKPIRPLSPWITDILLASPVGIRSDYFRWCSGIMGKYAAGELKPPSTASSRGSGKHPQLVPSTPRWAVANGAGVILSVCDDEVARNETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVDGVEVQHEPLGGYISSYKKQIEVPAAEASIEATAQGIASMLCAHGPEVEWRICTIWEAAYGLIPTSSSAVDLPEIIVATPLQPPVLSWNLYIPLLKVLEYLPRGSPSEACLMKIFAATVEAILQRTFPPESTREQNRKSKYLAGIGFGSASKNLAVAELRTMVHSLFLESCASVELASRLLFVVLTVCVSHEAQFSGSKRPRGEDNYSSEDIIEDLQTSENQKESKNRKLKKQGPVAAFDSYVLAAVCALACELQLFPLISRGNNHLASNKVQDIAKPVRLNGSSHELRNGLDSAVRHTHRILAILEALFSLKPSSVGTPWSYSSNEIVAAAMVAAHVSELFRRSKACMHALSVLIRCKWDNEIHSRASSLYNLIDIHSKAVASIVNKAEPLEATLIHAPIRKDSLVCVGVKRQNQCESSSCFDAGRTSVVPSEDSFPSKLDHNSNKTPCPKGASDYTLGKGVTGFSLDASDLANFLTMDRHIGLNCNGQIFLRSTLAEKQELCFSVVSLLWHKLIASPETQPCAESTSAQQGWRQVVDALCNVVSASPTKAATAVVLQAERELQPWIAKDDDSGQKMWRINQRIVKLIVELMRNHETAESLVIVASSSDLLLRATDGMLVDGEACTLPQLELLEATARAVQPVLEFGESGLAVADGLSNLLKCRLSATIRCLSHPSAHVRALSISVLRDILHTGSIRCSPKPRRLNGTHNPSYQYFNLDAVDWQADIEKCLTWEAHSRLSNGLSINFLDIAAKELGCTISM

SEQ ID NO: 13324 - protein, 1172 aa, Arachis hypogaea
MAASNERWIDRLQYSSLFWPPPPDGQQRKDQIAAYVEFFIQFTSEQFADDIAELIRNRYPSQEILLFDDVLATFVLHHPEHGHAVVLPIISCIIDGTIVYYKSSPPFASFISLVSPKSENEYSEQWALACGEILRILTHYNRPIFKTERQYGESERSSSGSHATTSDSVDGKSVQNSLIQQEKKPIRPLSPWITDILLAAPVGIRSDYFRWCSGVMGKYAAGELKPPTTASSRGSGKHPQLVPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRVLSQPALLFPPLRQVDGVEVQHEPLGGYISSYKKQIEVPAAEASMEATAQGIASMLCAHGPEVEWRICTIWEAAYGLIPTSSSAVDLPEIIVATPLQPPILSWNLYIPLLKVLEYLPRGSPSEACLMKIFAATVEAILQRTFPSDTTREQNRKSKYLFGVGSASKNLAVAELRTMVHSLFLESCASVELASRLLFVVLTVCVSHEAQFSGSKRPRGEDNYSAEEIIEDLHAVSEIQKETRNRKMKKQGPIAAFDSYVLAAVCALACELQLFPLISRGNNHSDSNNVKDIAKPFRINGTSHELQNGVDSAIRHTHRILAILEALFSLKPSSVGTPWSYSSNEIVAAAMVAAHVSELFRRSKACMHALSVLIRCKWDNEIHSRASSLYNLIDIHSKAVASIVIKAEPLEATLIHAPTWKDSVVSLGSKRHNQCESSSCFDPRQTSITTLEDSGPSKLNRKSDKTSCSNEASGGCTLGKGVTGFPLDASDLANFLTMDRHIGLSCNAQIFLRSMLAEKQELCFSVVSLLWHKLIASPETQPCAESTSAQQGWRQVVDALCNVVSASPTKAATAVVLQAERELQPWIAKDDDLGQKMWRVNQRIVKLIVELMRNHDSAESLVILASASDLLLRATDGMLVDGEACTLPQLELLEVTARAVQPVLELGESGLAVADGLSNLLKCRLSATVRCLSHPSAHVRALSISVLRDILHTGSIRSGPKPPQINGIHDPSYPYFNLDVTDWQADIEKCLTWEAHSQLSNELSIKYLNTAAKELGCTITI

SEQ ID NO: 13325 - protein, 1172 aa, Medicago truncatula
MAATSERWIDRLQFSSLFWPPPQDVQQKKDQIAAYVEYLIQFTSEQFADDIAELIRNRYPSKEIILFDDVLATFVLHHPEHGHAVVLPIISCIIDGTLVYDKTSPPFASLISLVCPKDENEYSEQWALACGEILRILTHYNRPIYKTERQSSETERSSSGSHATTSEPLNGKAVNNALAQQEKKPIRPLSPWITDILLVAPVGIRSDYFRWCSGVMGKYAAGELKPPSIATSRGSGKHPQLVPSTPRWAVANGAGVILSVCDDEVARNETAILTAAAVPALLLPPPTTALDEHLVAGLPALEPYARLFHRYYAIATPSATQRLLLGLLEAPPSWAPDALDAAVQLVELLRAAEEYASGIRLPRNWMHLHFLRAIGTAMSMRAGIAADAAAALLFRILSQPALLFPPLRQVDGVEVQHEPLGGYISSYSKQIEVPSAEASIDATAQGIASMLCAHGPEVEWRICTIWEAAYGLIPASSSAVDLPEIIVAAPLQPPILSWNLYIPLLKVLEYLPRGSPSEACLMKIFAATVEAILQRTFPPESSREQNRKANYLFGLGSASKNLAVAELRTMVHSLFLESCASVELSSRLLFVVLTVCVSHEAQFSGSKKPRGEDNYSVEEIIEDLQAISEIRKERKNRKVKKQGPVAAFDSYVMAAVCALACELQLFPLMSRGNNHSVSNNVQDIAKPVTLHGSSQDLQNGLDSAVRHTHRILAILEALFSLKPSSVGTPWSYSSNEIVAAAMVAAHVSELFRRSKACMHALSVLIRCKWNKEIHSRASSLYNLIDIHSKVVASIVNKAEPLEATLIHAPIYKDALVCHDGKRKNRSENGSCSDPGQTSIVPSADSTPSKHIHKSGRTPCSNEEASGYNLGKGVTSFSLEASDLANFLTMDRHIGLNCNTQIFLISMLSEKQELCFSVVSLLWHKLIASPETQPCSESTSAQQGWRQVVDALCNVVSASPAKAATAVVLQAEKELQPWIAKDDDLGQKMWRINQRIVKLIVELMRNHDSAESLVILASASDLLLRATDGMLVDGEACTLPQLELLEATARAIQPVLEFGEPGLAVADGLSNLLKCRLAATIRCLCHPSAHVRALSVSVLRDILHTGSIRCSPKPLRINGSHNPSYQYFKLDVVDWQADIEKCMAWEAHSRISAGLPIKFLDTAAKELGCAISV

SEQ ID NO: 13326 - protein, 1175 aa, Cicer arietinum
MAASSERWIDRLQYSSLFWPPPQDGQQKKDQIAAYVEYLIQFTSEQFADDIAEMIRNRYPSKEILLFDDVLATFVLHHPEHGHAVVLPIISCIIDGTLVYDKTSPPFASLISLVCPKNENEYSEQWALACGEILRILTHYNRPIYKMERQSSETERSSSGSHATTSEPLDGKAVNNALAQQEKKPIRPLSPWITDILLAAPVGIRSDYFRWCSGVMGKYAAGELKPPSTASSRGSGKHPQHVPSTPRWAVANGAGVILSVCDDEVARNETAILTAAAVPALLLPPPTTALDEHLVAGLPALEPYARLFHRYYAIATPSATQRLLLGLLEAPPSWAPDALDAAVQLVELLRAAEEYASGIRLPRNWMHLHFLRAIGTAMSMRAGIAADAAAALLFRILSQPALLFPPLRQVDGVEVQHEPLGGYISSYSKQIEVPAAEASIDATAQGIASLLCAHGPEVEWRICTIWEAAYGLIPASSSAVDLPEIIVASPLQPPTLSWNLYIPLLKVLEYLPRGSPSEACLMKIFAATVEAILQRTFPPESSREHNRKANYLFGIGSASKNLAVAELRTMVHSLFLESCASVELASRLLFVVLTVCVSHEAQFSGSKKPRGEDNYSVEEIIDDLQAISESRKERKNRKVKKQGPVAAFDSYVMAAVCALACELQLFPLMSRGNNHSVSNNVQDIAKPVTLNGSSQDLQNGIDSAVRHTHRILSILEALFSLKPSSVGTPWSCSSNEIVAAAMVAAHVSELFRRSKACMHALSVLIRCKWDKEIHSRASSLYNLIDIHSKVVASIVNKAEPLEATLIHAPIYKDSLVCHDGKRKNRSENGSCSDPGQTSIVPLEPSEDSTPSKHSHKSGRTPCSNEAASGYNMGKGVTGFSLDASDLANFLTMDRHIGLNCNTQIFLIPMLAEKQELCFSVVSLLWHKLIASPETQPCSESTSAQQGWRQVVDALCNVVSASPAKAATAVVLQAEKELQPWIAKDDDLGQKMWRVNQRIVKLIVELMRNHDSSESLVILASASDLLLRATDGMLVDGEACTLPQLELLEATARAVQPVLEFGESGLAVADGLSNLLKCRLAATIRCLSHPSAHVRTLSVSVLRDILHTSSIRCNPKPLRINGNHNPSYQYFKLDVVDWQTDIEKCLTCEAHSRISSGLPIKFLDTAAKELGCAISI

SEQ ID NO: 13327 - protein, 1171 aa, Pisum sativum
MAATSERWIDRLQFSSLFWPPPQDGQQKKDQIAAYVEYLIQFTSEQFADDIAELIRNRYPSKEILLFDDVLATFVLHHPEHGHAVVLPIISCIIDGTLVYDKTSPPFASLISLVCPKNENEYSEQWALACGEILRILTHYNRPIYKMERQSSETERSSSGSLATTSEPLNGKAVNSALAQEKKPIRPLSPWITDILLAAPVGIRSDYFRWCSGVMGKYAAGELKPPSTASSRGSGKHPQLVPSTPRWAVANGAGVILSVCDDEVARNETAILTAAAVPALLLPPPTTALDEHLVAGLPALEPYARLFHRYYAIATPSATQRLLLGLLEAPPSWAPDALDAAVQLVELLRAAEEYASGIRLPRNWMHLHFLRAIGTAMSMRAGIAADAAAALLFRILSQPALLFPPLRQVDGVEVQHEPLGGYISSYSKQIEVPAAEASIDATAQGIASMLCAHGPEVEWRICTIWEAAYGLIPANSSAVDLPEIIVAAPLQPPILSWNLYIPLLKVLEYLPRGSPSEACLMKIFAATVEAILQRTFPPESSREQNRKASYLFGIGSASKNLAVAELRTMVHSLFLESCASVELSSRLLFVVLTVCVSHEAQFSGSKKPRGEDNYSVEEIIEDLQAISEIRKERKNRKVKKQGPVAAFDSYVMAAVCALACELQLFPLISRGNNHSLSNNGQDIAKPVTLHGSSQDLQNGLESAVRHTHRILAILEALFSLKPSSVGTPWSYSSNEIVAAAMVAAHVSELFRRSKACMHALSVLIRCKWNKEIHSRASSLYNLIDIHSKVVASIVNKAEPLEATLIHAPIYKDSLVCHDGKRKNRSENGGCSDSRQTSTVPSEDSTPSKHSHKSGRTPCSNEEASGYNLGKGVTGFSLEASDLANFLTMDRHIGLNCNTQIFLISMLSEKQELCFSVVSLLWHKLIASPETQPCSESTSAQQGWRQVVDALCNVVSAAPAKAATAVVLQAEKELQPWIAKDDDLGQKMWRINQRIVKLIVELMRNHDSSESLVILASASDLLLRATDGMLVDGEACTLPQLELLEATARAIQPVLEFGEPGMAVADGLSNLLKCRLAATIRCLCHPSAHVRTLSVSVLRDILHTGSIRCSPKPLRINGNHNPSYPYFKLDVVDWQADIEKCLTCEAHSRISAGLPIKFLDTAAKELGCAISI

SEQ ID NO: 13328 - protein, 1170 aa, Theobroma cacao
MASPSERWIDGLQFSSLFWPPPQDPQQRKVQITAYVEYFGQFTSEQFPEDIAELVRNRYPHKEQRLFDDVLAMFVLHHPEHGHAVVLPIISCIIDGTLVYDKSTPPFASFISLVCPSSENEYSEQWALACGEILRILTHYNRPIYKMEQQNSETDRSNSSGQATTSEPVDGEPSFHIPLMQQERKPLRPLSPWITDILLAAPLGIRSDYFRWCSGVMGKYAAGDLKPPSTASSRGSGKHPQLMPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPLRQVEGVEVQHEPSGGYISCYRKQIEVPAAEATIEATAQGIASMLCAHGPEVEWRICTIWEAAYGLIPLSSSAVDLPEIIVATPLQPAILSWNLYIPLLKVLEYLPRGSPSEACLMKIFVATVEAILQRTFPPESSRVQTRKTRYSIGSASKNLAVAELRTMVHSLFLESCASVELASRLLFVVLTVCVSHEAQFSGSKRPRCEESYPPDEGIEESQSPSERPRDIKPRKTKKQGPVAAFDSYVLAAVCALACELQLFPLVTRGSNHSTAKDVQAIAKPAKLNGSSIEYGHSIDSAIHHTHRILAILEALFSLKPSSVGTSWSYSSNEIVAAAMVAAHVSELFRRSKACMHALSVLMRCKWDNEIYTRASSLYNLIDIHSKAVASIVNKAEPLEAQLIHAPVWKDSPVCLDGRKQNKRTNTTCFDPGQSSASECEDSTHSDKNLRCERVLASDEGSGNSLGKGIASFPLDASDLANFLTMDRHIGFNCSAQILLRSVLVEKQELCFSVVSLLWHKLIAAPETQPSAESTSAQQGWRQVVDALCNVVSASPTKAATAVVLQAEREFQPWITKDDDQGQKMWRINQRIVKLIVELMRNHDSPESLVIVASASDLLLRATDGMLVDGEACTLPQLELLEATARAVQPVLEWGESGLAVADGLSNLLKCRLPATTRCLSHPSAHVRALSTSVLRNILHAGSIKPNSKQVEINGIHGPSYQYFSVGVIDWHTDIEKCLTWEAHSQLARGMPIRFLDTAAKELGCSISI

SEQ ID NO: 13329 - protein, 1168 aa, Castanea mollissima
MAGSCERWIDRLQFSSLFWPPPQDAQQRKAQITAYVEFFGQFTSEQFPEDIAELIRNRYPSKEKRLFDDVLATFVLHHPEHGHAVVLPIISCIIDGTLVYDRTSSPFASFISLVCPSSENEYSEQWALACGEILRVLTHYNRPIYKMEQQNSDSERSSSGCHATTSDSCGESSHHIPLLQQERKPLRPLSPWITDILLAAPLGIRSDYFRWCSGVMGKYAAGELKPPTTASSRGSGKHPQLMPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVEGVEVQHEPLGGYISSYKKQIEVPAAEATIEATAQGIASMLCAHGPEVEWRICTIWEAAYGLIPLSSSAVDLPEIIVATPLQPPILSWNLYIPLLKVLEYLPRGSPSEACLMKIFVATVEAILQRTFPSESSKEQTRKTRYLYGIGSASKNLAVAELRTMVHSLFLESCASVELASRLLFVVLTVCVSHEAQSNGSKRPRGEESFPSNESVEDSQVISERQREMKTRKLKKQGPVAAFDSYVLAAVCALACELQLFPLISRASSHPNSKDVSDVVKPVKINGSSDEFRNSIDSAIRHTHRILAILEALFSLKPSTIGTSWSYSSNEIVAAAMVAAHISELFRRSKACMHALSVLMRCKWDNQIYTRASSLYNLIDIHSKAVASIVNKAEPLEAHLIHAPLWKKSLLNSDGKRRSQRENSVCFDPGQSSTPQSLDSAHSDTKFRASHPNEGSGNTLGKGIANLPLDASDLANFLTMDRHIGFNCSAQVLLRSVLPEKQELCFSVVSLLWHKLIAAPEIQPSAESTSAQQGWRQVLDALCNVVSASPTKAATAVVLQADRELQPWIAKDDDQGQKMWRINQRIVKLIVELMRNHDRPESLMILASASDLLLRATDGMLVDGEACTLPQLELLEATARAVQPVLEWGESGLAVADGLSNLLKCRLSATIRCLSHPSAHVRALSTSVLRDILHTGSIKSNSKPVDINGMSGPPYQYFSLGVIDWQDDIEKCLTWEAHSRLATGMSIEFLGTAAKELDCSISL

SEQ ID NO: 13330 - protein, 1038 aa, Glycine max
MACGEILRILTHYNRPIYKMERQYCEPEVSSGKSHATTNDSVDGESGHNSLMQQEKKPIRPLSPWITDILRAAPLGIRSDYFRWCSGVMGKYAAGELKPPTIVSARGSGKHPQLVPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYACGIRLPRNWMHFHFLRAIGTAMSMRSGVAADAAAALLFRILSQPALLFPPLRQVDGVEVQHEPLGGYISSNRKQIEAASAEATIEATAQGIASVLCAHGPEVEWRICTIWEAAYGLIPLNSSAVDLPEIVVATPLQPPILSWNLYIPLLKVLEYLPRGSPSEACLMKIFVATVEAILQRTFPAESTSDHKIKTRYYCVGSASKNLAVAELRTMVHSLFLESCASVELASRLLFVVLTVCVSHEVQFNGSKKPRGENNYLVEEIIEDLQAVSESQKETKNRKMKKQGPVAAFDSYVLAAVCALACELQLFPMISRGDNHSVPNNVQNIAKPVKIDGSSHALQNGIDSAIRHTHRILAILEALFSLKPSSVGTSWSYSSNEIVAAAMVAAHISELFRRSKACMRALSVLMRYKWDDEIHSRASSLYTLIDIHRKAVASIVNKAEPLGATFIHTPICKDPCDRSKRKNQCENSRCLDPGQTSTSTSEDSSRSKFSKKSERTSYSNEASGCTFEKATTSLPFDASDLANFLTMDRHIGFNCSAQIFLRSRLAEKQQLCFSVVSLLWQKLIGSPETQPCAESTSAQQGWRQVADALCKVVSASPTKAAMAVVLQAEKELQPWIAKDDNLGQKLWRINQRIVKLITELLRNHDNLESLVIVASASDLLLRATDGMLVDGEACTLPQLKLLEATAKAVQPVIELGESGLGVADGLSNLLKCRLPATIRCLSHPSAHVRALSSSVIRDILHTSSIGSSPKPLQKNGIHDQYLNFDVIDWRADVENCLTWEAHSRLSNGLSIEYLNTAADDLGFAISI

SEQ ID NO: 13331 - protein, 1166 aa, Glycine max
MAAASGERWMDRLQFSSLFWPPPLDDQQRKDQVAAYVEYIGQFTSEQFSEDIAELIRNHYPSKEMLLFDDVLAVLVLHHPEHGHAVVLPIISCIIDGTLDYDKTSPPFASFISLVCPKNENEYSEQWAMACGEILRILTHYNRPIYKMERQYCEPEVSSGKSHATTNDSVDGESGHNSLMQQEKKPIRPLSPWITDILRAAPLGIRSDYFRWCSGVMGKYAAGELKPPTIVSARGSGKHPQLVPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYACGIRLPRNWMHFHFLRAIGTAMSMRSGVAADAAAALLFRILSQPALLFPPLRQVDGVEVQHEPLGGYISSNRKQIEAASAEATIEATAQGIASVLCAHGPEVEWRICTIWEAAYGLIPLNSSAVDLPEIVVATPLQPPILSWNLYIPLLKVLEYLPRGSPSEACLMKIFVATVEAILQRTFPAESTSDHKIKTRYYCVGSASKNLAVAELRTMVHSLFLESCASVELASRLLFVVLTVCVSHEVQFNGSKKPRGENNYLVEEIIEDLQAVSESQKETKNRKMKKQGPVAAFDSYVLAAVCALACELQLFPMISRGDNHSVPNNVQNIAKPVKIDGSSHALQNGIDSAIRHTHRILAILEALFSLKPSSVGTSWSYSSNEIVAAAMVAAHISELFRRSKACMRALSVLMRYKWDDEIHSRASSLYTLIDIHRKAVASIVNKAEPLGATFIHTPICKDPCDRSKRKNQCENSRCLDPGQTSTSTSEDSSRSKFSKKSERTSYSNEASGCTFEKATTSLPFDASDLANFLTMDRHIGFNCSAQIFLRSRLAEKQQLCFSVVSLLWQKLIGSPETQPCAESTSAQQGWRQVADALCKVVSASPTKAAMAVVLQAEKELQPWIAKDDNLGQKLWRINQRIVKLITELLRNHDNLESLVIVASASDLLLRATDGMLVDGEACTLPQLKLLEATAKAVQPVIELGESGLGVADGLSNLLKCRLPATIRCLSHPSAHVRALSSSVIRDILHTSSIGSSPKPLQKNGIHDQYLNFDVIDWRADVENCLTWEAHSRLSNGLSIEYLNTAADDLGFAISI

SEQ ID NO: 13332 - protein, 1168 aa, Gossypium hirsutum
MANPSKRWIDGLQFSSLFWPPPQDPQERKVQITAYVEYFGQFTSEQFPEDIAELIRSRYPSKEQRLFDDVLATFVLHHPEHGHAVVLPIISGIIDGSLVYDKSSLPFASFISLVCPSSENEYSEQWALACGEILRILTHYNRPIYKMEPQNNETDRSHSSSQATTSESVDGEPSFQIPLMQQERKPLRPLSPWITDILLAAPLGIRSDYFRWCSGVMGKYAAGDLKPPTTASSRGSGKHPQLMPSTPRWAVANGAGVILSVCDEEVARYETASLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPIRQVEGVEVQHEPSGGYISCYRKQIEVPAAEATIEATAQGIASMLCAHGPEVEWRICTIWEAAYGLIPLSSSAVDLPEIIVSTPLQPPILSWNLYIPLLKVLEYLPRGSPSEACLMKIFVATVEAILQRTFPPESPREQTRKTRYSIGSASKNLAVAELRTMVHSLFLESCASIELASRLLFVVLTVCVSHEAQFSGSKRPRGEESYPSDEGIEESQAQSEKLKDIKPRKAKKQGPVAAFDSYVLAAVCALACELQLFPLVTRGNTHSTAKDVQAMANPAKVNGSSIEYGHGIDSAIHHTHRILAILEALFSLKPSSVGTSWGYSSNEIVAAAMVAAHISELFRRSKACMYALSVLMRCKWDNEIYTRASSLYNLIDIHSKAVASIVNKAEPLEAQLIYAPVRKYSPCLDDRKQNKCSSATCFDPGQSSASECEDSTCSDNNLRSEKLLASDEGLGNSLGKGIAGFPLDASDLANFLTRDRHIGFNCSAQILLRSVLVEKQELCFSVVSLLWHKLIAAPETQPSAESTSAQQGWRQVVDALCNVVSASPTKATTAVVLQADRELQPWIAKDDDQGQKMWRINQRIVKLIVELMRNHDSAESLVIVASASDLLLRATDGMLVDGEACTLPQLELLEATARAVQPVLEWGESGLAVADGLSNLLKCRLPATTRCLSHPSAHVRALSTSVLRNILHIGSINSKSKVEIYGIRGPSYQFFNIGAINWQNDIEKCLTWEVYSQLARGMTIQFLDTAAKELGCNISI

SEQ ID NO: 13333 - protein, 1168 aa, Gossypium raimondii
MANPSKRWIDGLQFSSLFWPPPQDPQERKVQITAYVEYFGQFTSEQFPEDIAELIRSRYPSKEQRLFDDVLATFVLHHPEHGHAVVLPIISGIIDGSLVYDKSSLPFASFISLVCPSSENEYSEQWALACGEILRILTHYNRPIYKMEPQNNETDRSHSSSQATTSESVDGEPSFQIPLMQQERKPLRPLSPWITDILLAAPLGIRSDYFRWCSGVMGKYAAGDLKPPTTASSRGSGKHPQLMPSTPRWAVANGAGVILSVCDEEVARYETASLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPIRQVEGVEVQHEPSGGYISCYRKQIEVPAAEATIEATAQGIASMLCAHGPEVEWRICTIWEAAYGLIPLSSSAVDLPEIIVSTPLQPPILSWNLYIPLLKVLEYLPRGSPSEACLMKIFVATVEAILQRTFPPESPREQTRKTRYSIGSASKNLAVAELRTMVHSLFLESCASIELASRLLFVVLTVCVSHEAQFSGSKRPRGEESYPPDEGVEESQAQSEKLKDIKPRKAKKQGPVAAFDSYVLAAVCALACELQLFPLVTRGNTHSTAKDVQAMANPAKVNGSSIEYGHGIDSAIHHTHRILAILEALFSLKPSSVGTSWGYSSNEIVAAAMVAAHISELFRRSKACMYALSVLMRCKWDNEIYTRASSLYNLIDIHSKAVASIVNKAEPLEAQLIYAPVRKYSPCLDDRKQNKCSSATCFDPGQSSASECEDSTCSDNNLRSEKLLASDEGLGNSLGKGIAGFPLDASDLANFLTRDRHIGFNCSAQILLRSVLVEKQELCFSVVSLLWHKLIAAPETQPSAESTSAQQGWRQVVDALCNVVSASPTKATTAVVLQADRELQPWIAKDDDQGQKMWRINQRIVKLIVELMRNHDSAESLVIVASASDLLLRATDGMLVDGEACTLPQLELLEATARAVQPVLEWGESGLAVADGLSNLLKCRLPATTRCLSHPSAHVRALSTSVLRNILHIGSINSKSKVEIYGIRGPSYQFFNIGAINWQTDIEKCLTWEVYSQLARGMTIQFLDTAAKELGCNISI

SEQ ID NO: 13334 - protein, 1170 aa, Vitis vinifera
MASSCERWIDGLQFSSLFWPPPQDVQQRKAQITAYVDYFGQFTSEQFPEDIAELIRSRYPSKEQRLFDDVLATFVLHHPEHGHAVVLPIISCIIDGTLVYDRCTPPFASFISLVCPSSENEYSEQWALACGEILRILTHYNRPIYKVEHQSSEADRSSSGRHATTSDSVDGKSSQGPLLQNERKPSRPLSPWITDILLAAPLGIRSDYFRWCGGVMGKYAAGELKPPSTASTRGSGKHPQLIPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYASGMRLPRNWMHLHFLRAIGTAMSMRAGIAADAAAALLFRVLSQPALLFPPLRQVEGFEFQHEPLDGYISSYKKQIEVPATEATIEATAQGIASMLCAHGPEVEWRICTIWEAAYGLIPLSSSAVDLPEIIVATPLQPPILSWNLYIPLLKVLEYLPRGSPSEACLMKIFVATVESILQRTFPAESSRENIRKTRYLFGIGSASKNLAVAELRTMVHALFLESCASVELASRLLFVVLTVCVSHEAAQQNGSKRPRGEDSHLSEEITEDLSDASGNQRDTKTRKMKKQGPVAAFDSYVLAAVCALACELQLFPLIARGTNHSASKDVQIRAKPAKLNGSSSEFRNSIDSAIRHTHRILAILEALFSLKPSSVGTSWSYSSNEIVAAAMVAAHVSELFRRSKACMHALSVLMRCKWDEEIYTRASSLYNLIDIHSKAVASIVNKAEPLEAHLIHATVWKDSPGHKDGSKENDCASTSCFKSVNPLLLHSEDSAYSKSLPKFEKAPHLNEGTGNSLGKGIASFPLDASELANFLTMDRHIGFSCSAQVLLRSVLAEKQELCFSVVSLLWHKLIAAPETKPSAESTSAQQGWRQVVDALCNVVSASPAKAATAVVLQAERELQPWIAKDDDLGQKMWRINQRIVKLIVELMRNHDRPESLVILSSASDLLLRATDGMLVDGEACTLPQLELLEATARAVQLVLEWGESGLAVADGLSNLLKCRVPATIRCLSHPSAHVRALSTSVLRDVLQSGSIKPHIKQGGRNGIHSYQYVNLGIIDWQADIEKCLTWEAHSRLATGMTNQFLDAAAKELGCTISI

SEQ ID NO: 13335 - protein, 1170 aa, Prunus mume
MAATSERWIDRLQFSSLFGPPPQDALRRKAQVTAYVDYFGQFTSEQFPEDIAELIRNRYPSEVKRLFDDVLAMFVLHHPEHGHAVILPIISCIIDGTLAYERISPPFASFISLVCPSSENEYSEQWALACGEILRILTHYNRPIYKVEQQNSETERSSSGSHATTSDSVDGESSHIPLVQQERKPIRPLSPWITDILLAAPLGIRSDYFRWCSGVMGKYAAGELKPPSTASSRGSGKHPQLMPSTPRWAVANGAGVILSVCDEEVARYETATLTAVAVPALLLPPPTTALDEHLVAGLPALEPYARLFHRYYAIATPSATQRLLLGLLEAPPSWAPDALDAAVQLVELLRAAEDYASGIRLPRNWLHLHFLRAIGTAMSMRAGIAADAAAALLFRILSQPALLFPPLRQVDGVEVQHEPLGGYISSYKKQIEVPEAEATIEATAQGIASMLCAHGPEVEWRICTIWEAAYGLIPLSSSAVDLPEIIVATPLQPPILSWNLYIPLLKVLEYLPRGSPSEACLMKIFVATVEAILQRTFPPESSREQNRKTRYLFGIGSTSKNLAVAELRTMVHSLFLESCASVELASRLLFVVLTVCVSHEAQSNGSKKARVEESYPADESVEESQKMSDKQRNRTKKTKKQGPVAAFDSYVLAAVCALACELQLFPLISKGTNHARSKDAKNVAKPAKENVCTNEFRSSVDSAVCHTRRILTILEALFLLKPSSIGTTWSYSSNEIIAAAMVAAHVSELFRWSKACMHALSVLMRCKWDSEICSRASSLYNLIDFHSKAVASIVNKAEPLEAHLRQVPIWRDSFVRFEGRKLSQDGNSRCLNVGQPSALQCEDSAHSETKHKSESASHSFEGSGNTFGKGVASFPLDASDLANFLTMDRHIGFNCSAQVLLRSVLTEKQELCFSVVSLLWHKLIAAPETQPSAESTSAQQGWRQVVDALCNVVSATPAKAATAVVLQAERELQPWIAKDDDQGQKMWRINQRIVKLIVELMRIHDSPESLVILSSASDLLLRATDGMLVDGEACTLPQLELLEATARAIQPVLEWGESGLAVADGLSNLLKCRLPATIRCLSHPSAHVRALSTSVLRDILQTSSIRPNPNPVEINGIHGPSYKYFNLDVIDWQADVEKCLTWEAHSRLATGMPIKFLDTAAKELGCSISI

SEQ ID NO: 13336 - protein, 1170 aa, Prunus persica
MAATSERWIDRLQFSSLFGPPPQDALRRKAQVTAYVDYFGQFTSEQFPEDIAELIRNRYPSELKRLFDDVLAMFVLHHPEHGHAVILPIISCIIDGTLAYERTSPPFASFISLVCPSSENEYSEQWALACGEILRILTHYNRPIYKVEQQNSETERSSSGSHATTSDSVDGESSHIPLVQQERKPIRPLSPWITDILLAAPLGIRSDYFRWCSGVMGKYAAGELKPPSTASSRGSGKHPQLMPSTPRWAVANGAGVILSVCDEEVARYETATLTAVAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVDGVEVQHEPLGGYISSYKKQIEVPEAEATIEATAQGIASMLCAHGPEVEWRICTIWEAAYGLIPLSSSAVDLPEIIVATPLQPPILSWNLYIPLLKVLEYLPRGSPSEACLMKIFVATVEAILQRTFPPESSREQNRKTRYLFGIGSTSKNLAVAELRTMVHSLFLESCASVELASRLLFVVLTVCVSHEAQSNGSKKARVEESYPADESVEESQKMSDKQRNRTKKTKKQGPVAAFDSYVLAAVCALACELQLFPLISKGINHAHSKDAKNVAKPAKENVCTNEFRSSVDSAVCHTRRILAILEALFLLKPSSVGTSWSYSSNEIIAAAMVAAHVSELFRWSKACMHALSVLMRCKWDSEICSRASSLYNLIDFHSKAVASIVNKAEPLEAHLRQVPIWRDSFVCFEGRKLSRGGNSRCLNVGQPSASQCEDSAHSETKQKSESASHSFEGSGNTFGKGVASFPLDASDLANFLIMDRHIGFNCSAQVLLRSVLTEKQELCFSVVSLLWHKLIAAPETQPSAESTSAQQGWRQVVDALCNVVSATPAKAATAVVLQAERELQPWIAKDDDQGQKMWRINQRIVKLIVELMRIHDSPESLVILSSASDLLLRATDGMLVDGEACTLPQLELLEATARAIQPVLEWGESGLAVADGLSNLLKCRLPATIRCLSHPSAHVRALSTSVLRDILQTSSIRPNPNPVEINGIHGPSYKYFNLDVIDWQADVEKCLTWEAHSRLATGMPIKFLDTAAKELGCSISI

SEQ ID NO: 13337 - protein, 1178 aa, Fragaria vesca
MACSSERWIDRLQFSSLFGPPPQDAPRRKAQITAYVEYFGQFTSEQFPEDISELIRNRYPSEVKRLFDDVLAMFVLHHPEHGHAVVLPIISCIIDGTLPYERTSPPFASFISLVCPSSEKEYSEQWALACGEILRILTHYNRPIYKVEQQNSETERSSSGSHATTSDSVDGESSHVPSVQQERKPIRPLSPWITDILLAAPLGIRSDYFRWCSGVMGKYAAGELKPPSTASSRGSGKHPQLMPSTPRWAVANGAGVILSVCDEEVSRYETATLTAVAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVEGVEVQHEPMGSRVSSYRKQIEVPAAEATIEATAQGIASMLCAHGPEVEWRICTIWEAAYGLIPLSSSAVDLPEIIVATPLQPPILSWNLYIPLLKVLEYLPRGSPSEACLMKIFVATVEAILQRTFPPESSREQNRKTRYLFGIGSASKNLAVAELRTMVHSLFLESCASVELASRLLFVVLTVCVSHEAQSSGSKKARVEESYPLEECVEESREMSGKQGDRKKTKKQGPVAAFDSYVLAAVCALACELQLFPLVSRGSNQSHSKDAKNIAKPAKPIGSANSYKQINGSSNEFQSSVDSAICHTRRILVILEALFLLKPSSVGTSWSYSSNEIVAAAMVAAHVSELFRWSKACMHALCVLMRCKWDNEISSRASSLYNLIDIHSKAVASIVNKAEPLEAHLMQVPIWRDSLVCSEGRKLSRCEKSKCINVGQSSVSQYEGSAYSETRVKSVTPSHSNGGSGTFGKGLANLPLDASELANFLTMDRHIGFSCSAQVLLRTVLTEKQELCFSVVSLLWHKLIASPETQPTAESTSAQQGWRQVVDALCNVVSATPTKAATAVVLQAERELQPWIAKDDDQGQKMWRINQRIVKLIVELMRIHDSPESLVILSSASDLLLRATDGMLVDGEACTLPQLELLEATARAVKPVLEWGESGLAVADGLSNLLKCRLSATIRCLSHPSAHVRALSVSVLRDILQTSSVRPNPNPVQINGIHGPSYKYFNLDVIDWQADIEKCLTWEAHSRLATGMPIKFLDTAAKELGCTISV

SEQ ID NO: 13338 - protein, 1170 aa, Vitis vinifera
MASSCERWIDGLQFSSLFWPPPQDVQQRKAQITAYVDYFGQFTSEQFPEDIAELIRSRYPSKEQRLFDDVLATFVLHHPEHGHAVVLPIISCIIDGTLVYDRCTPPFASFISLVCPSSENEYSEQWALACGEILRILTHYNRPIYKVEHQSSEADRSSSGRHATTSDSVDGKSSQGPLLQNERKPSRPLSPWITDILLAAPLGIRSDYFRWCGGVMGKYAAGELKPPSTASTRGSGKHPQLIPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYASGMRLPRNWMHLHFLRAIGTAMSMRAGIAADAAAALLFRVLSQPALLFPPLRQVEGFEFQHEPLDGYISSYKKQIEVPATEATIEATAQGIASMLCAHGPEVEWRICTIWEAAYGLIPLSSSAVDLPEIIVATPLQPPILSWNLYIPLLKVLEYLPRGSPSEACLMKIFVATVESILQRTFPAESSRENIRKTRYLFGIGSASKNLAVAELRTMVHALFLESCASVELASRLLFVVLTVCVSHEAAQQNGSKRPRGEDSHLSEEITEDLSDASGNQRDTKTRKMKKQGPVAAFDSYVLAAVCALACELQLFPLIARGTNHSASKDVQIRAKPAKLNGSSSEFRNSIDSAIRHTHRILAILEALFSLKPSSVGTSWSYSSNEIVAAAMVAAHVSELFRRSKACMHALSVLMRCKWDEEIYTRASSLYNLIDIHSKAVASIVNKAEPLEAHLIHATVWKDSPGHKDGSKEDDCASTSCFKSVNPLLLHSEDSAYSKSLPQFEKAPHLNEGTGNSLGKGIASFPLDASELANFLTMDRHIGFSCSAQVLLRSVLAEKQELCFSVVSLLWHKLIAAPETKPSAESTSAQQGWRQVVDALCNVVSASPAKAATAVVLQAERELQPWIAKDDDLGQKMWRINQRIVKLIVELMRNHDRPESLVILSSASDLLLRATDGMLVDGEACTLPQLELLEATARAVQLVLEWGESGLAVADGLSNLLKCRVPATIRCLSHPSAHVRALSTSVLRDVLQSGSIKPHIKQGGRNGIHSYQYVNLGIIDWQADIEKCLTWEAHSRLATGMTNQFLDAAAKELGCTISI

SEQ ID NO: 13339 - protein, 1022 aa, Gossypium raimondii
MEPQNNETDRSHSSSQATTSESVDGEPSFQIPLMQQERKPLRPLSPWITDILLAAPLGIRSDYFRWCSGVMGKYAAGDLKPPTTASSRGSGKHPQLMPSTPRWAVANGAGVILSVCDEEVARYETASLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPIRQVEGVEVQHEPSGGYISCYRKQIEVPAAEATIEATAQGIASMLCAHGPEVEWRICTIWEAAYGLIPLSSSAVDLPEIIVSTPLQPPILSWNLYIPLLKVLEYLPRGSPSEACLMKIFVATVEAILQRTFPPESPREQTRKTRYSIGSASKNLAVAELRTMVHSLFLESCASIELASRLLFVVLTVCVSHEAQFSGSKRPRGEESYPPDEGVEESQAQSEKLKDIKPRKAKKQGPVAAFDSYVLAAVCALACELQLFPLVTRGNTHSTAKDVQAMANPAKVNGSSIEYGHGIDSAIHHTHRILAILEALFSLKPSSVGTSWGYSSNEIVAAAMVAAHISELFRRSKACMYALSVLMRCKWDNEIYTRASSLYNLIDIHSKAVASIVNKAEPLEAQLIYAPVRKYSPCLDDRKQNKYSSATCFDPGQLSASECEDSTCSDNNLRSEKLLASDEGLGNSLGKGIAGFPLDASDLANFLTRDRHIGFNCSAQILLRSVLVEKQELCFSVVSLLWHKLIAAPETQPSAESTSAQQGWRQVVDALCNVVSASPTKATTAVVLQADRELQPWIAKDDDQGQKMWRINQRIVKLIVELMRNHDSAESLVIVASASDLLLRATDGMLVDGEACTLPQLELLEATARAVQPVLEWGESGLAVADGLSNLLKCRLPATTRCLSHPSAHVRALSTSVLRNILHIGSINSKSKVEIYGICGPSYQFFNIGAINWQTDIEKCLTWEVYSQLARGMTIQFLDTAAKELGCNISI

SEQ ID NO: 13340 - protein, 1165 aa, Phaseolus vulgaris
MAASSERWIDRLQFSSLFWPPPLEDQQRKDQIAAYVEYIGQFTSEQFPDDIAELIRNRYPSKEMLLFDEVLAVLVLHHPEHGHAVVLPIISCIIDGTLVYDKTSPPFASFISLVCPKNENEYSEQWALACGEILRILTLYNRPIYKMERQYCEAEGSSGGSHAMVNDSAYGESGHNSMMQQEKKPTRPLSPWITDILLAAPLGIRSDYFRWCSGVLGKYGAGELQPPMIVSARGSGKHPQLMPSTPRWAVANGAGVILSVCDNEVARYETATLTAVAVPALLLPPPTTALDEHLVAGLPALEPYARLFHRYYAIATPSATQRLLLGLLEAPPSWAPDALDAAVQLVELLRAAEEYACGIRLPRNWMHFHFLRAIGTAMSMRSGVAADAAAALLFRILSQPALLFPPLRQVDGVEIQHEPLGGYISSNRKQIEAAAAEATIEATAQGIASMLCAHGPEVEWRICTIWEAAYGLIPLNSSAVDLPEIVVATPLQPPILSWNLYIPLLKVLEYLPRGSPSEACLMKIFVATVEAILQRTFPAEPISDQKRKTRYYFVGSASKNLAVAELRTMVHSLFLESCASVELASRLLFVVLTVCVSHEVKFNGSKKPRGEDNYLEEVIEDLFPVSESQKETKNRKIKKQGPVSAFDSYVLAAVCALACELQLFPTVSRGNNRSVLNKVEKIAKPSKIDESSHALQKCIDSAIRHTHRILAILEALFSLKPSSVGTSWSYSSNEIVAAAMVAAHISELFRRSKACMRALSVLIRCKWDDEIHSRASSLYNLIDIHSKAVASIVNKAEPFGATLIHTPICKDPCGSIKGQNQFENSSHLDPGQTSTSISTDSSPLELGKRCDRTSYSNEASGCTFGKGATSLAFDASDLANFLTMDRHIGFNCSAQIFLRSRLAEKQELCFSVVSLLWQKLIASPETQPCAESTSAQQGWRQVVDALCQVVSASPMKAATAVVLQAEKELQPWIAKDDNLGQKMWRINQRIVKLIIELMRNHDSLESLVVVASASDLLLRATDGMLVDGEACTLTQLKLLEATAKAVQPVIELGESGFAVADGLSNLLKCRLPATIRCLSHPSAHVRALSTSVLRDILHTCSIRRYSPKRPQKNDIHNQYFNLDVIDWQADINKCLTWEAHSQLLNGMSIEYLNTAARDLGFGISI

SEQ ID NO: 13341 - protein, 1134 aa, Gossypium hirsutum
MSSILVSSHQNNSLRILLSLFAPAIHLRSNTFLYDVLATFVLHHPEHGHAVVLPIISGIIDGSLVYDKSSLPFASFISLVCPSSENEYSEQWALACGEILRILTHYNRPIYKMEPQNNETDRSHSSSQATTSESVDGEPSFQIPLMQQERKPLRALSPWITDILLAAPLGIRSDYFRWCSGVMGKYAAGDLKPPTTASSRGSGKHPQLMPSTPRWAVANGAGVILSVCDEEVARYETASLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPIRQVEGVEVQHEPSGGYISCYRKQIEVPAAEATIEATAQGIASMLCAHGPEVEWRICTIWEAAYGLIPLSSSAVDLPEIIVSTPLQPPILSWNLYIPLLKVLEYLPRGSPSEACLMKIFVATVEAILQRTFPPESPREQTRKTRYSIGSASKNLAVAELRTMVHSLFLESCASIELASRLLFVVLTVCVSHEAQFSGSKRPRGEESYPPDEGVEESQAQSEKLKDIKPRKAKKQGPVAAFDSYVLAAVCALACELQLFPLVTRGNTHSTAKDVQAMANPAKVNGSSIEYGHGIDSAIHHTHRILAILEALFSLKPSSVGTSWGYSSNEIVAAAMVAAHISELFRRSKACMYALSVLMRCKWDNEIYTRASSLYNLIDIHSKAVASIVNKAEPLEAQLIYAPVRKYSPCLDDRKQNKYSSATCFDPGQLSASECEDSTCSDNNLRSEKLLASDEGLGNSLGKGIAGFPLDASDLANFLTRDRHIGFNCSAQILLRSVLVEKQELCFSVVSLLWHKLIAAPETQPSAESTSAQQGWRQVVDALCNVVSASPTKATTAVVLQADRELQPWIAKDDDQGQKMWRINQRIVKLIVELMRNHDSAESLVIVASASDLLLRATDGMLVDGEACTLPQLELLEATARAVQPVLEWGESGLAVADGLSNLLKCRLPATTRCLSHPSAHVRALSTSVLRNILHIGSINSKSKVEINGICGPSYQFFNIGAINWQTDIEKCLTWEVYSQLARGMTIQFLDTAAKELGCNISI

SEQ ID NO: 13342 - protein, 1172 aa, Manihot esculenta
MASSSERWIDGLQFSSLFWPPPQDAQQRKAQITAYVEYFGQFTSEQFPDDIAELIRNRYPSKEKRLFDDVLATFVLHHPEHGHAVVLPIISCLIDGLVYDRSSPPFASFISLVCPSSENEYSEQWALACGEILRILTHYNRPVYKVEQQNSETERSNGGNHATSSGSVDRESCPTPSVQQERKPLRPLSPWITDILLAAPLGIRSDYFRWCSGVMGKYAAGELKPPITASSRGSGKHPQLMPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGIAMSMRAGIAADAAAALLFRILSQPALLFPPLRQVEGVEVQLEPLGGYFSSYRKQIEVPAAEATIEATAQGIASMLCAHGPEVEWRICTIWEAAYGLIPLGSSAVDLPEIVVATPLQPPILSWNLYIPLLKVLEYLPRGSPSEACLMKIFVATVEAILTRTFPPQSSREQTRKARYFSGLGSASKNLAVAELRTMVHSLFLESCASVELASRLLFIVLTVCVSHEAQSKGSKRPRDEESLPTDDSNEPSQLTSEVQKNMKYRKLKKQGPVAAFDSYVLAAVCALACELQLFPFISRGSNHSSSKNARTLAKPVKLNGCNGSSSEFQSSFDSAVHHTHRILAILEALFSLKPSSVGTSWSYSSNEIVAAAMVAAHVSELFRRSKACMHALSVLMRCKWDNEIYTRASSLYNLIDIHSKAVASIVTKAEPLEAHLQVPVWKDSLVCFDGKRQNKKLSIRCFDSGQSSASQCVESTHSDATIITERSSCSKEGSGSTLGKDIAAFPLDASDLANFLTMDRHIGFNFSAQVLLRTLLVEKQELCFSVVSLLWHKMIAAPETQPSAVSTSAQQGWRQVVDALCNVVSASPTKAATAIVLQAERELQPWIAKDDDQGQKLWRINQRIVRLMVELMRNHDTPESLVILASASDLLLRATDGMLVDGEACTLPQLELLEATARAVQPVLEWGESGFAVADGLSNLLKCRLPATIRCLSHPSAHVRALSTSVLRSILHTCSIKPTANQADINDIRGPSYQLFKVDVIDWQADIEKCLTWEAHSRLATGMAIQFLETAAKELGCTVSI

SEQ ID NO: 13343 - protein, 1171 aa, Populus trichocarpa
MASSSSERWIDGLQFSSLFWPPPQDAQQRKAQITAYVDYFGQCTSEHFPDDISELIRNRYPSKDKRLFDDVLATFVLHHPEHGHAVVLPIISCIIDGTLVYDRSSPPFASFISLVCPGSENEYSEQWALACGEILRILTHYNRPIYKREQQNNETDRSSSDSHATSSESAEGKSTSMPLVQQERKPFRPLSPWITDILLAAPLGIRSDYFRWCSGVMGKYAAGELKPPTTTSSRGSGKHPQLIPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRQVEGVEVQHEPLGGYISCYRKQIEVPAAEATIEATAQGIASMLCAHGPEVEWRICTIWEAAYGLIPLSSSAVDLPEIIVATPLQPPLLSWNLYIPLLKVLEYLPRGSPSEACLMKIFVATVEAILQRTFPPESSREQTRRTRYFSSLGPASKNLAVAELRTMVHSLFLESCASVELASRLLFVVLTVCVSHEAHSRGSKRPRGEENDLPEDGTEDSQSTSEMRRNMKSRRMKKQGPVAAFDSYVLAAVCALACELQIFPFVSRGSNHSTSKHSETVAKPAKLNGAVSEFQTSLNSAIHHTHRILSILEALFSLKPSTIGTSWSYSSNEIVAAAMVAAHVSELFRRSKACMHALSVLMRCKWDNEIYTRASSLYNLIDVHSKAVASIVNKAEPLGAHLHAPVWKDSLVCSDGNKQNRSASTGCFNSGQSSALQSTELVHSETKLKCGRASHSEEGSGSTSGKGIAGLPLDASDLANFLTMHRHIGFNCSAQVLLRSVLPEKQELCFSVVSLLWQKLIASPETQPSAESTSAQQGWRQVVDALCNVVSASPTIAATAVVLQAERELQPWITKDDDSGQKMWRINQRIVKLIVELMRNHDTPESLVILASASDLLLRATDGMLVDGEACTLPQLELLEATARAVQPVLQWGESGFAVADGLSNLLKCRLPATIRCLSHPSAHVRALSTSVLRDIQHTGSIKPASKLTHRNGIHGPSYQYFRSDVINWQADIEKCLTWEAHSRLATGMPVHHLDTAAKELGCTISI

SEQ ID NO: 13344 - protein, 295 aa, Cicer arietinum
MDLTKLNAAQLTLYGSAFCVMLSMHFTLQLLSQHLFYWKNPKEQRAIVIIILMAPIYAIVSFVGLLDVRGSKEFFTLLESVKECYEALVIAKFLSLMYSYLKISISKNIVPDEIKGREIHHSFPMTLFQPHSVRLNHHNLKLLKYWTWQFVVIRPVCSILIISLQLLGLYPNWLSWVFTIILNVSVSLALYSLVIFYHVFAKELAPHKPLAKFLCIKGIVFFCFWQGMVLDILVAAGVIKSRHLKLDVEHIEEAMQNILVCIEMVVFSVLQQYAYHASPYSGEVEKMLKQNKKNE

SEQ ID NO: 13345 - protein, 296 aa, Trigonella foenum-graecum
MDLTQLSPAQLTLYGSAFCVMLSMHFTLQLLSQHLFYWKNPKEQKAIIIIILMAPIYAIVSFVGLLDIRGSKEFFTLLESIKECYEALVIAKFLALMYSYLNISITRNIVPDEIKGREIHHSFPMTLFQPHSVRLNHHNLKLLKYWTWQFVVIRPVCSILMITLQLVGLYPNWLSWTITIILNTSVSLALYSLVIFYHVFAKELEPHKPLAKFLCIKGIVFFCFWQGLVLDGLVAVGVIQSRHLKLDVEHIEEAMQNILVCIEMVVFSVLQQYAYHASPYSGEVEKMLKQNNKKNE

SEQ ID NO: 13346 - protein, 296 aa, Medicago truncatula
MDLTQLNPAQITVYGSAFCVMLSMHFTLQLLSQHLFYWKNPKEQKAIIIIILMAPIYAIVSFVGLLDIRGSKEFFTLLESIKECYEAFVIAKFLSLMYSYLKISITKNIVPDEIKGREIHHSFPMTLFQPHSVRLNHHNLKLLKYWTWQFVVIRPVCSILMITLQLVGFYPNWLSWIITIILNISVSLALYSLVIFYHVFAKELEPHKPLAKFLCIKGIVFFCFWQGLVLDGLVAVGVIQSRHLKLDVEHIEEAMQNILVCIEMVVFSVLQQYAYHASPYSGEVEKMLKQNNKKNE

SEQ ID NO: 13347 - protein, 232 aa, Lotus japonicus
MDLSKMNPRQLTTVGSAFGAMLSMHFTTQLLSQHLFYWKNPKEQRAIIIIILMAPIYAVVSFVGLLDIEGSKEFFTFLESVKECYEALVIAKFLALMYSYLNISISKNIVPDEIKGREIHHSFPMTLFQPHTVRLNHHTLKLLKYWTWQFVVVRPVCSILMILLQLIGLYPTWLSWTFTIILNISVSLALYSLVIFYHVFAKELAPHKPLANFCASRELFSSAFGREWFSMV

SEQ ID NO: 13348 - protein, 295 aa, Theobroma cacao
MDFSHLNRGQITLMGSAFCVMLTMHFTLQLLSQHLFYWKNPKEQKAILIIILMAPIYAIDSFVGLLDVRGSKAFFMFLESVKECYEALVIAKFLALMYSYLNISISKNIVPDEIKGREIHHSFPMTLFQPRTVRLNHRTLKLLKHWTWQFVVIRPVCSILMIILQVLGVYPSWLSWTFTIILNISVSLALYSLVIFYHVFAKELAPHKPLAKFMCIKGIVFFCFWQGVVLDILVAMGIIRSHHFWLDVEHLEEALQNVLVCLEMVVFSVLQQYAYHVAPYSGEVEAKMKLGKKNE

SEQ ID NO: 13349 - protein, 305 aa, Lupinus angustifolius
MGFNLLAALNPALAHLNPAQLTLMGSAFCVLASMHFTTQLMSQHLFYWKNPKEQKAILIIILMAPIYAAVSFVGLLDIKGSKEFFMFLESVKECYEALVIAKFLALMYSYLNISISRNIVPDEIKGREIHHTFPMTLFQPHSVRLNQQKLKLLKQWTWQFVIIRPVCSILMIALQLLGLYPTWLSWTFTAILNISVSLALYSLVIFYHVFAKELAPHKPLAKFLCIKGIVFFCFWQGMVLDILAATGVLKSLPFKLDVEHIEEAMQNILVCVEMVVFSVLQQYAYHASPYSGQVEQMLRQNKKYE

SEQ ID NO: 13350 - protein, 294 aa, Ricinus communis
MDISTLNRGQLTLMGSAFCTMLSMHFTVQLLSQHLFYWKNPKEQKAILIIILMAPIYAIDSFVGLLDIRGSKAFFMFLDSIKECYEALVIAKFLALMYSYLNISISKNIVPDEIKGREIHHSFPMTLFQPHTVRLDHRTLRLLKYWTWQFVIIRPICSVLMITLQILGTYPTWLSWTFTIILNISVSLALYSLVVFYHVFAKELTPHKPLAKFLCIKGIVFFCFWQGVVLDILVAIGIIRSHHFWLDVEHIEEALQNVLVCLEMVVFSVLQQYAYHVAPYSGDIERKMKLNKNE

SEQ ID NO: 13351 - protein, 294 aa, Manihot esculenta
MDITTLNPGQLTLMGSAFCTMITMHFTLQLLSQHLFYWKNPKEQKAIIIIILMAPIYAIDSFVGLLDIQGSKAFFMFLDSIKECYEALVIAKFLALMYSYLNISISRNIVPDGIKGREIHHSFPMTLFQPRTVRLDHRTLRLLKYWTWQFVIIRPICSILMITLQLLGFYPSWLSWTFTIILNISVSLALYSLVVFYHVFAKELAPHNPLAKFLCIKGIVFFCFWQGVVLDILVGLGIIRSHHFWLDVEHIEEALQNVLVCLEMVVFSVLQQYAYHVSPYSGEVETKLKLNKKD

SEQ ID NO: 13352 - protein, 296 aa, Euphorbia peplus
MIDFNALDRGQITLLGSAFCTMLTMHFTLQLLSQHMFYWKNPKEQKAIIIIILMAPIYAIDSFVGLLDIQGSKEFFMFLDSIKECYEALVIAKFMALMYSYLNISISGKVVPDEIKGREIHLSFPMTLFQPRTLLLNHKTLKLLKYWTWQFVVIRPICSILMISLQLLGIYPTWLSWTFTIILNVSVSLALYSLVLFYHVFAKELAPHNPLAKFMCIKGIVFFCFWQGVVLDILVAAGFIKSNHFWLDVEHIEEALQNVLVCLEMVVFSVLQQYAYHVAPYSGEVESKFKLNKKRE

SEQ ID NO: 13353 - protein, 295 aa, Prunus mume
MDLSTMDRGQLTLLGSASCVMLTMHFSVQLLSQHLFYWKNPKEQKAIIIIILMAPIYAVDSFVGLLDIQGSKTFFMFLDSIKECYEALVIAKFLALMYSYLKISISKNIVPDEIKGREIHHSFPMTLFQPHTVRLNHHTLKLLKYWTWQFVIIRPVCSVLMITLQALGLYPSWLSWTFTIILNVSVSLALYSLVVFYHVFAKELAPHSPLAKFLCIKGIVFFCFWQGVVIDVLAAVGVIRSHHFWLDVEHIEEAIQNVLICLEMVVFSVLQQYAYHVAPYSGDVESKMKLNKKRE

SEQ ID NO: 13354 - protein, 295 aa, Prunus persica
MDLSTMDRGQLTLLGSAACVMLTMHFSVQLLSQHLFYWKNPKEQKAIIIIILMAPIYAVDSFVGLLDIQGSKTFFMFLDSIKECYEALVIAKFLALMYSYLKISISKNIVPDEIKGREIHHSFPMTLFQPHTVRLNHHTLKLLKYWTWQFVIIRPVCSVLMITLQALGLYPSWLSWTFTIILNVSVSLALYSLVVFYHVFAKELAPHSPLAKFLCIKGIVFFCFWQGVVIDVLAAVGVIRSHHFWLDVEHIEEAIQNVLICLEMVVFSVLQQYAYHVAPYSGDVESKMKLNKKRE

SEQ ID NO: 13355 - protein, 296 aa, Euphorbia esula
  misc_feature (135)..(135): Xaa can be any naturally occurring amino acid
  misc_feature (191)..(191): Xaa can be any naturally occurring amino acid
MIDFNALDRGQITLLGSAFCTMLTMHFTLQLLSQHMFYWKNPKEQKAIIIIILMAPIYAIDSFVGLLDIQGSKEFFMFLDSIKECYEALVIAKFMALMYSYLNISISGKVVPDEIKGREIHLSFPMTLFQPRTLXLNHKTLKLLKYWTWQFVVIRPICSILMISLQLLGIYPTWLSWTFTIILNVSVSLAXYSLVLFYHVFAKELAPHNPLAKFMCIKGIVFFCFWQGVVLDILVAAGFIKSNHFWLDVEHIEEALQNVLVCLEMVVFSVLQQYAYHVAPYSGEVESKFKLNKKRE

SEQ ID NO: 13356 - protein, 847 aa, Glycine max
MEQNLMLAAEAEREKSKAMSDSDERMKETLALTAEAERDRDNSMSDFDDSDSEDEAQQNLQLESLQTELVTNPSNYDAHLQYITLLRRMGDVDKLSRAREAMSELFPLSPAIWRQWIKDELSLNTATRPEAFSRILKLYERGVFDYLSVSLWCDYINFVQEFDPMVRQCSPTGISKARDLFESALTAAGLHVAEGSKIWEAYRKYEQAILLTFDDIDAQAKEKQVQSIRSLFHRQLSVPLAGMSSTITAYKTWEVEQGSLQDVESIDLVDIYPHVAASYQKALDMYNARFHLEEQILSPNVSDSERLQHYMNYLKFEQSSGTPARIQVLYERAITDFPITPDLWLDYTCNLDNTLKVGNIVNNVYSRATKNCPWVGELWVRCMLSLERGHASEKDLSEIFEKSLQCTFSTLDEYLDLFLTRVDGLRRRMASSNEEDLEYKIIRETFQRASDYLSPYLKNTEGLLHLHAYWARLETKLGKDITAARGVWENCLKICGSMLESWTGYIAMEVELGHINEARSIYKRCYSKRFSGTGSEDICQSWLRFEREFGKLEDFDHALHKVTPRLEELKLFRIQQESKTAEESEKNPKRNAREKRKLGSDITEEQYPTKRFRDVGNPKKAPEENKYQLQNTSQVTKVEGANWKNTKIDDNPSEQQFNHEKNRAYSDQCTVFISNLHPTANYEHIRNFFGDDGGIVAIRILHDKFTGKSRGLAYVDFLDEEHLAAAIAKNRQKLIGKKLSIARSDPKRGGKESSNPKTWTEHARATNHSSQKGFVSKETDDTHKGDVKDAKFSSRKPGNDNIQLKGKNTFAVPRNVKPLGFTANKLKAEEGDEKPKSNEEFRKMFIR

SEQ ID NO: 13357 - protein, 837 aa, Glycine max
MEQNLNLTAEAMSDSDERMKETLALSSEAERDRDKSMSDSDSEDEAQQNLQIESLQTELVTNPSNYDAHLQYIRLLRRMGDVDKLSRAREAMSELFPLSPTMWRQWIKDELSLNTAARPEAFSRILKLYERGVFDYLSVSLWCDYINFVQEFDPMVRQFSPTGISKARDLFESALTAAGLHVAEGSKIWEAYKKYEQDILLTFDDTDEQAKEKQVQRIRSLFHRQLSVPLAGMSSTITAYKTWEMEQGSLQDVESIDLVDIYPHVAASYQKALEMYNARFHLEEQILSPNISDSERLQHYMNYLKFEQSSGMPARIQVLYERAITDFPITPDLWLDCTRNLDNTLKVGNIVSNVYSRATKNCPWVGELWVRYMLSLERGHASEKDLSEIFEKSLLCTFSTLDEYLDLFLTRVDGLRRRMASSSEEDLEYKIIRETFQRASDYLSPYLKNTEGLLHLHAYWARLETKLGKDITAARGVWENCLKLCGSMLESWTGYIAMEVELGHINEARSIYKRCYSKRFSGTGSEDICQSWLRFEREFGKLEDFDHALHKVTPRMDELKLFRMQQESKSAEESEKNTKRNAREKRKLGSDITEEQSPSKRFRDVGNPKKAPEENKYHVQNISQVTKVEGVNWKNTKIDDNPSEQQFSHEKNRGYSDQCTAFLSNLHPTANYEHIRNFFSDVGGIVAIRILHDKFTGKSRGLAYVDFLDEEHLAAAIAKNRLKLIGKKLSIARSDPKRGGRESSNPKTLTEHADATNHSSQKASGSKETDDTYKGDVKDVKFSSRKPGNDNIQLKGKNTFAVPRNVRPLGFTTNKPKAEEGDEKPKSNEEFRKIFIR

SEQ ID NO: 13358 - protein, 578 aa, Cajanus cajan
MGLCHGKPIETSQSEGGHHVFPGEKEVVASPKTTTKGSKFPFYSPSPLPSLFKNSPANSSVSSTPLRLFKRPFPPPSPAKHIRALLARRHGSVKPNEASIPEGSECEVGLDKSFGFSNHFQAHYELGPEVGRGHFGYTCSAKGKKGTFKGHDVAVKVIPKSKMTTAIAIEDVRREVKILRALSGHKNLVQFYEAYEDNDNVYIVMELCKGGELLDKILSRGGKYSEEDARVVMIQILSVVAFCHLQGVVHRDLKPENFLYVSKDENSTLKVIDFGLSDYVKPDERLNDIVGSAYYVAPEVLHRSYGTEADMWSIGVIAYILLCGSRPFWARTESGIFRAVLKADPSFDEAPWPSLSANAIDFVKRLLNKDYRKRLTAAQALSHPWLANHSDDVKIPFDMIIHKLVKAYICSSSLRKSALGALAKTLTLVQLAYLREQFNILGPNKSGLISMQNFKTGILRSATDASKDSRVLDYVNMVSSIQYRKLDFEEFCAAAISVHQLEGMESWEQHARRAYELFDKEGNRPIMIEELASELGLSPSVPIHVVLQDWIRHSDGKLSFLGFVRLLHGVSSRTFQKA

SEQ ID NO: 13359 - protein, 583 aa, Lotus japonicus
MGLCHGKPIETTRHHEGAAANPEFPNANEILPLPPSTHSTKSSKFQFFSPSPLPSFFKNSPANSSVSSTPLRIFKRPFPPPSPAKHIRALLARRHGSVKPNEASIPEGSECEVGLDKSFGFSKNFLAHYELGQEVGRGHFGYTCAAKGKKGSFKGHDVAVKVIPKSKMTTAIAIEDVRREVKILRALTGHKNLVQFYEAYEDDENVYIVMELCKGGELLDKILSRGGKYSEEDARVVMTQILSVVAYCHLQGVVHRDLKPENFLFASEDENSSLKAIDFGLSDYVKPDERLNDIVGSAYYVAPEVLHRSYGTEGDMWSIGVIAYILLCGSRPFWARTESGIFRAVLKADPSFDEAPWPSLSADAIDFVKRLLNKDYRKRLTAAQALSHPWLVSHSDDIKIPFDMIIHKLVKAYICSSSLRKSALGALAKTLTLVQLAYLREQFTLLGPNKNGLISMQNFKMAILRSATDASKDSRVLDYVTMISSIQYRKLDFEEFCAAAISVHQLEGMDTWEQHARRAYELFEKDGNRPIMIEELASELGLSPSVPIHVVLQDWIRHSDGKLSFLGFVRLLHGVSSRTFQKA

SEQ ID NO: 13360 - protein, 579 aa, Cajanus cajan
MGICHGKPIETQQQESSHEFPNEVAPSTTKPTKPAKFPFYSPSPLPSWFKNSPSSNSNPGSVGSTPLRIFKRPFPPPSPAKHIRALLARRHGSVKPNEASIPEGPECELGLDKTFGFAKHFSAHYELNEEVGRGHFGYTCSAKPKKGPFKGIDVAVKVIPKPKMTTAIAIEDVRREVKILRALTGHKNLVQFYEAYEDDDNVYIVMELCKGGELLDRILSRGGKYSEEDARVVMIQILSVVAFCHLQGVVHRDLKPENFLFTSKDENSTLKAIDFGLSDYVKPDERLNDIVGSAYYVAPEVLHRSYGTEADMWSIGVIAYILLCGSRPFWARTESGIFRAVLKADPSFDEAPWPSLSTDAKDFVKRLLNKDYRKRLTAAQALSHPWLVNHHDDMRIPLDMIIHKLVKAYICSSSLRKSALGALAKTLTVTQLAYLRDQFTLLGPNKSGLISMQNFKTAILRSSTDASKDSRVLDYVNMVSSIQYRKLDFEEFCAAAISVHQLEGMESWEQHARRAYELFEKDGNRPIMIEELASELGLSPSVPVHVVLQDWIRHSDGKLSFLGFVRLLHGVSSRAFQKA

SEQ ID NO: 13361 - protein, 594 aa, Arachis hypogaea
MGLCHGKPIETSQRGVGGRGEDPSSFIDEKGVVVSLPPPTPSSQTTKPSSKFPFFSPSPLPSFFKNSPAPGSNPSSVSSTPLRIFKRPFPPPSPAKHIRALLARRHGSVKPNEASIPEGSECEVGLDKSFGFSKQFLVHYELGEEVGRGHFGYTCSAKGKKGTFKGHEVAVKVIPKAKMTTAIAIEDVRREVKILRALTGHKNLVQFYEAYEDDDNVYIVMELCKGGELLDKILSRGGKYSEEDARVVMIQILSVVAYCHLQGVVHRDLKPENFLFASKEENSTLKAIDFGLSDYVKPDERLNDIVGSAYYVAPEVLHRSYGTEADMWSIGVIAYILLCGSRPFWARTESGIFRAVLKADPSFDEAPWPSLSADAIDFVKRLLNKDYRKRLTAAQALSHPWLANHCDDLKIPIDMIIPKQVKAYICSSSLRKSALGALAKTLTLVQLAYLREQFTQLGPNKNGTISMQNFKTGVLRCATDASKDSRVLDYVSMVSSIQYRKLDFEEFCAAAISVHQLEGMETWEHHARRAYELFEKDGNRPIMIEELASELGLSPSVPVHVVLQDWIRHSDGKLSFLGFVRLLHGASSRTFHKA

SEQ ID NO: 13362 - protein, 593 aa, Cicer arietinum
MGLCHGKPIETSQREREISSFQSEEILQLPPPQPTTTTTSSHHHATTKSSSKFPFFSPSPLPSFFKNSPANSNSSVSSTPLRIFKRPFPPPSPAKHIRALLARRHGSVKPNEATIPEGSECEVGLDKSFGFSKHFVTHFELGQEVGRGHFGYTCSAKGKKGSFKGHDVAVKVISKSKMTTAIAIEDVRREVKILRALTGHKNLVQFYESYEDDENVYIVMELCKGGELLDKILSRGGKYSEEDARVVLIQILSVVAYCHLQGVVHRDLKPENFLFSSEEENSTLKAIDFGLSDYVKPDERLNDIVGSAYYVAPEVLHRSYGTEADMWSIGVIAYILLCGSRPFWARTESGIFRAVLKADPSFDEAPWPSLSIDAKDFVKRLLNKDYRKRLTAAQALSHPWLANHTEDIKIPFDMIIHKLVKTYICSSSLRKSALGALAKTLTLVQLAYLREQFTLLGPNKSGLISMQNFKTAILRSATDASKDSRVLDYVNMVSSIQYRKLDFEEFCAAAISVHQLEGMESWEQHARRAYELFEKDGNRPIMIEELASELGLSPSVPIHVVLQDWIRHSDGKLSFLGFVRLLHGVSSRTFHKA

SEQ ID NO: 13363 - protein, 577 aa, Phaseolus vulgaris
MGICHGKPIETQQSERENPEFPNDVPSSTNTKPSKFPFYSPSPLPGWFKKSPANSNPSSVSSTPLRIFKRPFPPPSPAKHIRALLARRQGSVKPNEASIPEGSECEIGLDKRFGFAKNFSAHYEISEEVGRGHFGYTCSAKPKKGPSKAIEVAVKVIPKSKMTTAIAIEDVRREVKILRALTGHKNLVQFYEAYEDDENVYIVMELCKGGELLDRILSRGGKYPENDARVVMIQILSVVAFCHLQGVVHRDLKPENFLFTSKDENSTLKAIDFGLSDYVKPDERLNDIVGSAYYVAPEVLHRSYGTEADMWSIGVIAYILLCGSRPFWARTESGIFRAVLKADPSFDEAPWPSLSADAKDFVKRLLNKDYRKRLTAAQALSHPWLVNHHDDMRIPLDMIIHKLVKAYICSSSLRKSALRALAKTLTVAQLAYLRDQFTLLGPNKSGLISMQNFKTAVLRSSTDASKDSRVLDYVNMVSSIQYRKLDFEEFCAAAISMHQLEGMESWEQHARRAYELFEKEGNRPIMIEELASELGLSPSVPVHVVLQDWIRHSDGKLSFLGFVRLLHGVSSRAFQKA

SEQ ID NO: 13364 - protein, 579 aa, Lupinus angustifolius
MGLCHAKPIETSQTQRENQPFQNDNEVLPLPPRSSSKFPFYSPSPLHKFFKNSPSNSTPSSVSSTPLRLFKRPFPPPSPAKHIKALLARRHGSVKPNEATIPEGNECEVGLDKSFGFSKQFEVHYELGEEVGRGHFGYTCSAKGKKGSLKGHEVAVKVIPKSKMTTAIAIEDVRREVKILRALTGHKNLVKFYEAYEDDNNVYIVMELCEGGELLDKILSRGGKYSEEDAKVVMVQILSVVAFCHLQGVVHRDLKPENFLFTSKDENSTLKAIDFGLSDYVKPDERLNDIVGSAYYVAPEVLHRSYGTEADMWSIGIIAYILLCGSRPFWARTESGIFRAVLKADPSFDEGPWLSLSADATDFVKRLLNKDYRKRLTAAQALSHPWLTNHGDDMKIPFDMIIPKLVNAYICSSSLRKTALRALAKTLTLVQLAYLKEQFTLLGPNKSGLISMQNFKTAILKSATDASKDSRVLDYVNMVSSIQYRKLDFEEFCAAAISVHQLEGMESWEQHARSAYELFEKDGNRPIMVEELASELGLSPSVPVHVVLQDWIRHSDGKLSFLGFVRLLHGVSSRTLQKA

SEQ ID NO: 13365 - protein, 595 aa, Medicago truncatula
MGLCHGKPIETSRRERERERENSTNEEILQLPPPPSSSHHHHAPTKSSSKFPFFSPSPLPSFFKNSPANSTVSSNSTPLRTPLRIFKRPFPPPSPAKHIRALLARRHGSVKPNEATIPEGSECEVGLDKSFGFSKHFVTNFELGQEVGRGHFGYTCSAKGKKGSFKGLDVAVKVIPKSKMTTAIAIEDVRREVKILRALTGHKNLVQFYEAYEDEENVYVVMELCKGGELLDKILSRGGKYPEEDARVVLIQILSVVAYCHLQGVVHRDLKPENFLFSSEDENSTLKAIDFGLSDYVKPDERLNDIVGSAYYVAPEVLHRSYGTEADMWSIGVIAYILLCGSRPFWARTESGIFRAVLKADPSFDEAPWPSLSADAKDFVKRLLNKDYRKRLTAAQALSHPWLVNHLEDIKIPFDMIIHKLIKTYICSSSLRKSALGALAKTLTLVQLAYLREQFTLLGPNKSGLISMQNFKTAVLRSATDASKDSRVLDYANMVSSIQYRKLDFEEFCAAAISVHQLEGMDTWEQHARRAYELFEKDGNRPIMIEELASELGLSPSVPIHVVLQDWIRHSDGKLSFLGFVRLLHGVSSRTFHKA

SEQ ID NO: 13366 - protein, 583 aa, Glycine max
MGICHGKPIETQQSQRETNNPSEFPSDHPTPTKPPKASSKFPFYSPSPLPNWFKNSPSSNSNPSSVSSTPLRIFKRPFPPPSPAKHIRALLARRHGSVKPNEAAIPEGSECEVGLDKSFGFAKQFSAHYELSDEVGRGHFGYTCSAKGKKGAFKGVDVAVKVIPKAKMTTAIAIEDVRREVKILRALTGHKNLVQFYEAYEDDANVYIVMELCKGGELLDRILSRGGKYSEEDARVVMIQILSVVAFCHLQGVVHRDLKPENFLFTSKDDNSSLKAIDFGLSDYVKPDERLNDIVGSAYYVAPEVLHRSYGTEADMWSIGVIAYILLCGSRPFWARTESGIFRAVLKADPSFDEAPWPSLSVDAKDFVKRLLNKDYRKRLTAAQALSHPWLVNHHDDMRIPLDMIIHKLVKAYICSSSLRKSALRALAKTLTVAQLTYLRDQYTLLGPNKSGLISMQNFKTAVLRSSTDASKDSRVLEYVSMVSSIQYRKLDFEEFCAAAISVHQLEGMETWEQHARRAYELFEKEGNRPIMIEELASELGLSPSVPVHVVLQDWIRHSDGKLSFLGFVRLLHGVSARAFQKA

SEQ ID NO: 13367 - protein, 254 aa, Fagus grandifolia
MGLCHGKPIQNPQTIQTWHPGENEPVPNSQTPKSSNFPFYSPSPLPSLFKNSPAVNSSVSSTPLRIFKRPFPPPSPAKHIRALLARRHGSVKPNEASIPEGDECEIALDKNFGYSKQFVAHYELGEEVGRGHFGFTCSAKAKKGSLKGQDVAVKVIPKSKMTTAIAIEDVRREVKILRALTGHKNLVQFYEAYEDDDNVYVVMELCKGGELLDKILSRGGKYSEEDAKEVMVQILSVVAYCHLQGVVHRDLKPE

SEQ ID NO: 13368 - protein, 580 aa, Lupinus angustifolius
MGLCHGKPIETSQTQRENQSFQNDKEVVLPLPPRSSSKFPFYSPSPLHKFFKNSPSNSTPSSVSSTPLRLFKRPFPPPSPAKHIRALLARRHGSVKPNEATIPEGSECEVGLDKSFGFSKEFEVHYELGEEIGRGHFGYTCSAKGKKGSLKGQEVAVKVIPKSKMTTAIAIEDVRREVKILRALTGHKNLVQFYEAYEDDNNVHIVMELCKGGELLDKILSRGGKYPEEDAKDVMIQILNAVAFCHLQGVVHRDLKPENFLFTSKDDNSTLKAIDFGLSDYVKPDERLNDIVGSAYYVAPEVLHRSYGTEADMWSIGVIAYILLCGSRPFWARTESGIFRAVLKTDPSFDEGPWPSLSANAIDFVKRLLNKDYRKRLTAAQALSHPWLANHSDDIRIPFDMIIPKLIKAYICSSPLCKTALGALAKTLTLVQLAYLKEQFTLLGPNKSGLISMQNFKMAVLKSATDASKESRVLDYVNTFSSIQYRKLDFEEFCAASISVHQLEGMESWEQHARTAYDLFEKDGNRPIMVEELASELGLSPSVPVHVVLQDWIRHSDGKLSFLGFVRLLHGVSSRTLQKA

SEQ ID NO: 13369 - protein, 576 aa, Prunus mume
MGLCHGKPTENPKAQSQDSTIPSESEPYALNSHSTKSSNFPFYSPSPLPSLFKNSPANSSVSSTPLRIFKRPFPPPSPAKHIRALLARRHGSVKPNEASIPEGSECDVALDKNFGFSKQFVAHYELGDEVGRGHFGYTCSAKAKKGSLKGQDVAVKVIPKSKMTTAIAIEDVRREVKILRALTHKNLVQFYEAYEDDDNVYVVMELCKGGELLDSILSRGGKYSEDDAKAVMVQILSVTAYCHLQGVVHRDLKPENFLFTSSDEKSPLKAIDFGLSDYVKPDERLNDIVGSAYYVAPEVLHRSYGTEADMWSIGVIAYILLCGSRPFWARTESGIFRAVLKADPSFDEAPWPSLSSDARDFVKRLLNKDYRKRLTASQALCHPWLANCHEVKIPMDMIVYKLVKAYICSSALRKSALGTLAKTLSVAQLAYLRDQFTLLGPNKSGFISMQNFKTGVIRNSTDAMKDSRVLDYVNMISSIRYRKLDFEEFCAAAISVHQLEGMESWEQHARRAYELFEKDGNRPIMIEELASELGLSPSVPVHVVLQDWIRHSDGKLSFLGFVRLLHGVSSRTFQKA

SEQ ID NO: 13370 - protein, 415 aa, Amsonia hubrichtii
MTTAIAIEDVRREVKILRALTGHKNLVQFYDAYEDEDNVYIVMELCRGGELLDRILSRGGKYSEEDAKAVMVQILSVVAYCHLQGVVHRDLKPENFLFTSKDENSPLKAIDFGLSDYVKPDERLNDIVGSAYYVAPEVLHRSYGTEADMWSIGVIAYILLCGSRPFWARTESGIFRAVLKADPSFDEAPWPSLSADAVDFVKRLLNKDYRKRLTAAQALSHPWLAGHHDVKIPLDMIIYKLVRAYTCSSSLRKAALGALAESLTVPQLAYLREQFTILGPNKSGYVSLANFKTAVSKYSTDAMKDSRVFEYVNMVSSIQYRKMDFEEFSAAAISVHQLEGMESWEQHARRAYELFEKDGNRPIMIEELASELGLSPSVPVHVVLQDWIRHSDGKLSFLGFVRLLHGVSSRTFQKT

SEQ ID NO: 13371 - protein, 414 aa, Prunus persica
MTTAIAIEDVRREVKILRALTHKNLVQFYEAYEDDDNVYVVMELCKGGELLDSILSRGGKYSEDDAKAVMVQILSVTAYCHLQGVVHRDLKPENFLFTSSDEKSPLKAIDFGLSDYVKPDERLNDIVGSAYYVAPEVLHRSYGTEADMWSIGVIAYILLCGSRPFWARTESGIFRAVLKADPSFDEAPWPSLSSDARDFVKRLLNKDYRKRLTASQALCHPWLANYHEVKIPMDMIVYKLVKAYICSSALRKSALGTLAKTLSVAQLAYLRDQFTLLGPNKSGFISMQNFKTGVIRNSTDAMKDSRVLDYVNMISSIRYRKLDFEEFCAAAISVHQLEGMESWEQHARRAYELFEKDGNRPIMIEELASELGLSPSVPVHVVLQDWIRHSDGKLSFLGFVRLLHGVSSRTFQKA

SEQ ID NO: 13372 - protein, 577 aa, Malus domestica
MGLCHGKPTENPQPHSQDLTIPGENEAFDAPNSQSSKSSNFPFYSPSPLPSLFKNSPANSSVSSTPLRLFKRPFPPPSPAKHIRALLARRHGSVKPNEASIPEGSECEVALDKNFGFSKQFGSHYELGDEVGRGHFGYTCSAKAKKGSLKGQDVAVKVIPKSKMTTAISIEDVRREVKILRALTHKNLVQFYEAYEDDDNVYVAMELCKGGELLDSILSRDGKYSEADAKAVMVQILSVTAYCHLQGVVHRDLKPENFLFTSSDEKSPLKAIDFGLSDYVKPDERLNDIVGSAYYVAPEVLHRSYGAEADMWSIGVIAYILLCGSRPFWARTESGIFRAVLKADPSFDEAPWPSLSSDAIDFVKRLLNKDYRKRLTAAQALCHPWLANYHEVKIPMDMIVYKLVKAYICSSALRKSALRTLAKTLSVAQLAYLRDQFTLLGPNKSGFITMQNFKMGLTRNSTDAMKDSLVLDYVNMISSIRYRKLDFEEFCASAISVYQLEGMESWEHHARRAYELFEKDGNRPIMIEELATELGLSPSVPVHVVLQDWIRHSDGKLSFLGFVRLLHGVSSRTFQKA

SEQ ID NO: 13373 - protein, 576 aa, Unknown
  Sequence found in Organisms: Gossypium hirsutum, Gossypium raimondii
MGLCHGKPIENQQKQSRDISIPAEKDAAPNSNSSKSSNFPFYSPSPLPSLFKTSPAVPSVNSTPLRFFKRPFPPPSPAKHIKSLLARRHGSIKPNEASIPEGSECEVGLNKSFGFSKHFTSHYELGEEVGRGHFGYTCSAKAKKGSLKGNDAAVKVIPKSKMTTAIAIEDVRREVKILRALTGHKNLVQFYDAYEDDENVYIVMELCKGGELLDRILSRGGKYPEEDAKAVMVQILSVVAFCHLQGVVHRDLKPENFLFTTKDEGSPLKAIDFGLSDYVKPDERLNDIVGSAYYVAPEVLHRSYGTEADMWSIGVIAYILLCGSRPFWARTESGIFRAVLKADPSFDEAPWPSLSPDAIDFVKRLLNKDYRKRLTAAQALSHPWLANCHDIKIPSDMIICRLVKAYIGSSTLRRAALGALAKTLTIPQLAYLREQFSLLGPNKSGFILMQNFKTVMLKNSTDAMKDSRVLDYVNMISSIQYRKLDFEEFCASAISVHQLEGMETWEQHARRAYDLFDKDGNRPIMIEELASELGLSSSVPVHVVLQDWIRHSDGKLSFLGFVRLLHGVSSRTFQKS

SEQ ID NO: 13374 - protein, 576 aa, Theobroma cacao
MGLCHGKPTEHQQNQSRDISIPGENDPPANAHSTKSSNFPFYSPSPLPSLFKTSPAISSVNSTPLRIFKRPFPPPSPAKHIRALLARRHGSIKPNEASIPEGNECDIGLDKNFGFSKHFMSHYELGEEVGRGHFGYTCTAKGKKGSLKGHDVAVKVIPKSKMTTAIAIEDVRREVKILRALTGHKNLVQFYDAYEDDDNVYIVMELCRGGELLDRILSRGGKYSEEDAKTVVVQILSVVAFCHLQGVVHRDLKPENFLFTSKQENSPLKAIDFGLSDYVKPDERLNDIVGSAYYVAPEVLHRSYGTEADMWSIGVIAYILLCGSRPFWARTESGIFRAVLKADPSFDEAPWPSLSPEAIDFVKRLLNKDYRKRLTAAQALSHPWLANYHEIKIPSDMIICRLVKAYIGSSALRKTALGALAKTLTVPQLAYLREQFTLLGPNKNGFISMQNYKTALMKNSTDAMKDSRVLDYVNMISTLQYRKLDFEEFCAASISVHQLEGMETWEQHARRAYDLFEKDGNRPIMIEELASELGLSPSVPVHVVLQDWIRHSDGKLSFLGFVRLLHGISSRTFQKS

SEQ ID NO: 13375 - protein, 576 aa, Gossypium raimondii
MGLCHGKPIENQQKQSRDISIPAEKDAAPNSNSSKSSNFPFYSPSPLPSLFKTSPAVPSVNSTPLRFFKRPFPPPSPAKHIKSLLARRHGSIKPNEASIPEGSECEVGLNKSFGFSKHFTSHYELGEEVGRGHFGYTCSAKAKKGSLKGNDAAVKVIPKSKMTTAIAIEDVRREVKILRALTGHKNLVQFYDAYEDDENVYIVMELCKGGELLDRILSRGGKYPEEDAKAVMVQILSVVAFCHLQGVVHRDLKPENFLFTTKDEGSPLKAIDFGLSDYVKPDERLNDIVGSAYYVAPEVLHRSYGTEADMWSIGVIAYILLCGSRPFWARTESGIFRAVLKADPSFDEAPWPSLSPDAIDFVKRLLNKDYRKRLTAAQALSHPWLANFHDIKIPSDMIICRLVKAYIGSSTLRRAALGALAKTLTIPQLAYLREQFSLLGPNKSGFILMQNFKTVMLKNSTDAMKDSRVLDYVNMISSIQYRKLDFEEFCASAISVHQLEGMETWEQHARRAYDLFDKDGNRPIMIEELASELGLSSSVPVHVVLQDWIRHSDGKLSFLGFVRLLHGVSSRTFQKS

SEQ ID NO: 13376 - protein, 265 aa, Panax ginseng
MGLCHGKPIENSQNQPGNPIIPSENELVLNSQSGKASKFPFYSPSPLPGAYKDSPANSSVSSTPLRTPLRLFKRPFPPPSPAKHIRALLARRHGSIKPNEASIPEGNELEIGLDKSFGYSKQLLTHYELGEEVGRGHFGYTCSAKGKKGSLKGQDVAVKVIPKSKMTTAIAIEDVRREVKILRALTGHKNLVQFYDAYEDEDNVYVVMELCKGGELLDRILSRGGKYTEEDAKAVMVQILSVVAYCHLQGVVHRDLKPENFLFVF

SEQ ID NO: 13377 - protein, 580 aa, Panax ginseng
MGLCHGKPIENSQNQPGNPIIPSENELVLNSQSGKASKFPFYSPSPLPGAYKDSPANSSVSSTPLRTPIRLFKRPFPPPSPAKHIRALLARRHGSIKPNEASIPEGNELEIGLDKSFGYSKQLLTHYELGEEVGRGHFGYTCSAKGKKGSLKGQDVAVKVIPKSKMTTAIAIEDVRREVKILRALTGHKNLVQFYDAYEDEDNVYVVMELCKGGELLDRILSRGGKYTEEDAKAVMVQILSVVAYCHLQGVVHRDLKPENFLFVSKDEHSPLKAIDFGLSDYVKPDERLNDIVGSAYYVAPEVLHRSYGTEADMWSIGVIAYILLCGSRPFWARTESGIFRAVLKADPSFDESPWPSLSSDAVDFVKRLLNKDYRKRLTAAQALSHPWLANYHDVKIPLDMIIYKVVKAYICSSSLRKAALGALAKTLTIPQLAYLREQFTLLGPSKSGFISLQNFKLAVTKNCTEAIKDSRVLDFANMVSSLQYRKLDLEEFCAAAISVHQLEGMDSWEQHARRAYELFEKDGNRPIIIEELASELGLSPSVPVHVVLQDWIRHSDGKLSFLGFVRLLHGVSSRAFQKA

SEQ ID NO: 13378 - protein, 128 aa, Vinca minor
MGLCYGKPNEPPQNLSENPKIPTDNEPEALSSSTTHTGRKTPKFPFYSPSPLVPSAFKNSPANSSVSSTPLRLFKRPFPPPSPAKHIRALLARRHGSVKPNEATIPEGSECEIGLDKILDSLRFCKSL

SEQ ID NO: 13379 - protein, 575 aa, Vitis vinifera
MGLCQGKPIENPQTQSQDLIIPGDGELSTNTQTTKTPKFPFYSPSPLPSGFKNSPANSSVSSTPLRIFKRPFPPPSPAKHIRALLARRHGSVKPNEATIPEGNECEVGLDKNFGFSKQFVAHYEMGEEVGRGHFGYTSSAKAKKGSLKGQDVAVKVIAKSKMTTAIAIEDVRREVKILRALTGHKNLVQFYEAYEDDDNVYIVMELCRGGELLDRILARGGKYSEEDAKAVMVQILNVTAFCHLQGVVHRDLKPENFLFISKEENSPLKAIDFGLSDYVKPDERLNDIVGSAYYVAPEVLHRSYGTEADMWSVGVIAYILLCGSRPFWARTESGIFKAVLKADPSFDEAPWPSLSSDAIDFVKRLLNKDYRKRLTAAQALSHPWLANYHDVKIPLDMIVYKLVKAYIFSSSLRKSALAALAKTLSIAQLAYFREQFTLLGPNKSGFVSLQNFKTAVTKNSTDAIKDSRVLEYVSMVGSLQYRKLDFEEFCAAAISVLQLEGMESWEQHARRGYELFEKDGNRPIMIEELASELGLSPSVPVHVVLQDWIRHSDGKLSFLGFVRLLHGPSRAFPKA

SEQ ID NO: 13380 - protein, 578 aa, Populus trichocarpa
MGLCHGKPIELQKNQSKNNTLSIETDSTQPANSHTSKTSNFPFYSPSPLPSLFKTSPAISSVSSTPLRIFKRPFPPPSPAKHIRALLARRHGSVKPNEASIPEGSESDIALDKNFGFSKQFVSHYELGEEVGRGHFGYTCSAKAKKGSLKGQDVAVKVIPKSKMTTAIAIEDVRREVKILRALTGHNNLVQFYDAYEDDDNVYVVMELCKGGELLDRILSRGGKYSEEDAKTVMVQILSVVAYCHLQGVVHRDLKPENFLFTTKEENSPLKAIDFGLSDYVKLDERLNDIVGSAYYVAPEVLHRSYGTEADMWSIGVIAYILLCGSRPFWARTESGIFRAVLKADPSFDEAPWPSLSPEAIDFVKRLLNKDYRKRLTAAQALSHPWLANHHDLKIPLDMIVYKLVKAYISSSSLRKSALGALAKTLTVAQLAYLREQFTLLGPSKNGFISMQNFKTAVIKHSTDAMKDSRVLDYVNMISTLQYRKLDFEEFSAVAISVHQLEGMDCWEQHARRAYELFEKDGNRPIMIEELASELGLSPSVPVHVVLQDWIRHSDGKLSFLGFVRLLHGVSSRTFQKA

SEQ ID NO: 13381 - protein, 74 aa, Lupinus angustifolius
MGICNGKPIETKQITIVENNTDKDVLPSSNKTKSASKFPFYSPSPLPSWFKNSPANSNSNSTPTTIVLVQLQHL

SEQ ID NO: 13382 - protein, 573 aa, Citrullus lanatus
MGLCHGKPTEENQKPNSENPNSVIQTETPKTPSNFPFYSPSPLPNLFKNSSPANSSLSSTPLRLFKRPFPPPSPAKHIRALLARRHGSVKPNEASIPEGSECDVALDKNFGYSKHFAAHYDLGDEVGRGHFGYTCSARAKKGSLKGQQVAVKIIPKSKMTTAIAIEDVRREVKILRALTGHKNLVQFYDSYEDEDNVYVVMELCEGGELLDRILSRGGKYSEEDAKIIMVQILSVVAYCHLQGVVHRDLKPENFLFTSKDENSTLKAIDFGLSDYVKPDERLNDIVGSAYYVAPEVLHRSYGTEADMWSIGVIAYILLCGSRPFWARTESGIFRAVLKADPNFDEAPWPSLSTDAIDFVKRLLNKDYRKRLTAAQALCHPWLADHQDIKIPLDTITYKLVRSYICSSSLRKSALGALAKTLSAVQLGYLQKQFTLLGPNKNGFISMQNFKTALIKNSTDAIKDSRVLDYANVVSSIQYRKLDFEEFCAAAISIYQLEGMENWDQHARHAYDLFDKDGNRPIMIEELASELGLSPSVPVHVVLQDWIRHSDGKLSFLGFVRLLHGVSSRAFQKA

SEQ ID NO: 13383 - protein, 581 aa, Vinca minor
MGLCHGKPIEPPQNLSENTTIPTDNEPALSSSTTHTGRKTPKFPFYSPSPLVPSAFKNSPANSSVSSTPLRLFKRPFPPPSPAKHIRALLARRHGSVKPNEATIPEGSECDIGLDKNFGFTRNFVSYYELGEEVGRGHFGYTCSGKGKKGSLKGQDVAVKVIPKSKMTTAIAIEDIRREVKILRALTGHKNLVQFYDAYEDEDNVYVVMELCKGGELLDRILSRGGKYSEEDAKVVMVQILSVVAYCHLQGVVHRDLKPENFLFTSKDEKSPLKAIDFGLSDYVKPDERLNDIVGSAYYVAPEVLHRSYGTEADMWSIGVIVYILLCGSRPFWARTESGIFRAVLKADPGFDEVPWPSLSPEAVDFVKGLLNKDYRKRLTAAQALSHPWLAGHHDDKIPLDMIIYKFVRAYTCSSSLRKAALGALAKTLTVPQLAYLREQFTILGPNKSGYVSLQNFKSAVSKCSTDAMKDSRVFEYVSMVSSLQYRKMDFEEFSAAAISVHQLEGAQSWEQHARRAYELFEKDGNRPIMIEELASELGLSPSVPVHVVLQDWIRHSDGKLSFLGFVRLLHGVSSRTFQKS

SEQ ID NO: 13384 - protein, 576 aa, Euonymus alatus
MGLCHAKPIEHPQNQPNNFTISTESDPPPNSRSNKSSNFPFYSPSPLPSLFKNSPAISSVISTPLRLFKRPFPPPSPAKHIRALLARRQGSVKPNEASIPEGSEGEIGLDKNFGYSKQFVSHYEIGEEVGRGHFGYTCSARGKKGSLKDQYVAVKVMPKSKMTTAIAIEDVRREVKILRALTGHKNLVQFYDAYEDDENVYIAMELCEGGELLDRILSRGGKYSEEDAKIVLVQILSVVAFCHLQGVVHRDLKPENFLFTTKEENSTLKAIDFGLSDYVKPDERLNDIVGSAYYVAPEVLHRSYGTEADMWSIGVIAYILLCGSRPFWARMESGIFRAVLKSDPSFDEAPWPSLSPEAIDFVKRLLNKDYRKRLTASQALSHPWLANHHDLKIPLDMIVFKLVRAYTCSSSLRKSALGALARTLTVSQLAYLREQFTLLGPTKNGFISMQNFKMAVVRNSTHAMKDSRVLDYVQMVGSIQYRKLDFEEFCAAAISVHQLEGMDCWEQHATRAYELFEKDGNRPIMIEELASELGLSPSVPVHVVLQDWIRHSDGKLSFLGFVRLLHGASSRSFQKA

SEQ ID NO: 13385 - protein, 576 aa, Chenopodium quinoa
MGLCHAKPIKIPETQYENGEINGEIQPQNSGSGKTPKFPFYSPSPLPSAFKNSPANSSVTSTPLRFFKRPFPPPSPAKHIRALLARRHGSVKPNEASIPEGSECDIGLDKNFGFSKQFANHFEIGEEVGRGHFGYTCYGKGKKGSLKGLDVAVKVIPKAKMTTAIAIEDVRREVKILRALTGHKNLVQFYESYEDDDNVYVVMELCQGGELLDRILSRGGKFSEEDAKAVMVQILSVTAYCHLQGVVHRDLKPENFLFTSKDENAPLKAIDFGLSDYVKPDERLNDIVGSAYYVAPEVLHRAYGTEADMWSIGVIAYILLCGSRPFWSRTESGIFRAVLKADPSFDEAPWPSLSPEAIDFVKRLLNKDYRKRLTAAQALSHPWLSGYHQDDKIPQDMIVYRLVRAYICSSSLRKAALGALAKTLTVPQLAYMKEQFQMLSPSKNGYISMQNFKTAVLRNATDAMKDSRVIEYVNLVSSIQYRKMDFEEFCAAAISVHQLEAMETWEQHARRAYELFEKDGNRPIMIEELASELGLSPSVPVHVVLQDWIRHSDGKLSFLGFVRLLHGVSSRTFQKA

SEQ ID NO: 13386 - protein, 534 aa, Tabernaemontana elegans
SPSPLRSAFKNSPANSSVSSTPLRLFKRPFPPPSPAKHIRALLARRHGSVKPNEATIPEGSECEIGLDKNFGFTKNFASHYELGEEVGRGHFGYTCSAKGRKGSLKGQDVAVKVIPKSKMTTAIAIEDVRREVKILRALTGHKNLVQFYDAYEDEDNVYVVMELCKGGELLDRILSRGGKYSEEDAKAVMVQILGVVAYCHLQGVVHRDLKPENFLFTSKDENSPLKAIDFGLSDYVKPDERLNDIVGSAYYVAPEVLHRSYGTEADMWSIGVIAYILLCGSRPFWARTESGIFRAVLKADPSFDEAPWPSLSSDAVDFVKRLLNKDYRKRLTAAQALSHPWLAGHHDVKIPLDMIIYKLVRAYTCSSSLRKAALGALAKTLTVQQLAYLREQFTILGPNKSGYVSIQNFKTAVSKYSTDAMKDSRVFEYVSMVGSIQYRKMDFEEFSAAAISVHQLEGMESWEQHARRAYELFEKDGNRPIMIEELASELGLSPSVPVHVVLQDWIRHSDGKLSFLGFVRLLHGVSTRTFQKA

SEQ ID NO: 13387 - protein, 576 aa, Chenopodium quinoa
MGLCHAKPIKIPETQYENGEINGEIQPQNSGSGKTPKFPFYSPSPLPSAFKNSPANSSVTSTPLRFFKRPFPPPSPAKHIRALLARRHGSVKPNEASIPEGSECDIGLDKNFGFSKQFANHFEIGEEVGRGHFGYTCYGKGKKGSLKGLDVAVKVIPKAKMTTAIAIEDVRREVKILRALTGHKNLVQFYESYEDDDNVYVVMELCQGGELLDRILSRGGKFSEEDAKAVMVQILSVTAYCHLQGVVHRDLKPENFLFTSKDENAPLKAIDFGLSDYVKPDERLNDIVGSAYYVAPEVLHRAYGTEADMWSIGVIAYILLCGSRPFWSRTESGIFRAVLKADPSFDEAPWPSLSPEAIDFVKRLLNKDYRKRLTAAQALSHPWLSGYHQDDKIPQDMIVYRLVRAYICSSSLRKAALGALAKTLTVPQLAYMKEQFQMLSPSKNGYISMQNFKAAVLRNATDAMKDSRVIEYVNLVSSIQYRKMDFEEFCAAAISVHQLEAMETWEQHARRAYELFEKDGNRPIMIEELASELGLGPSVPVHVVLQDWIRHSDGKLSFLGFVRLLHGVSSRTFQKA

SEQ ID NO: 13388 - protein, 573 aa, Cucumis sativus
MGLCHGKPIEQNPKPNSENPNSVIQSETPKTPTNFPFYSPSPLPNLFKSSSPANSSITSTPLRLFKRPFPPPSPAKHIRALLARRHGSVKPNEASIPEGSECDVALDKNFGYSKHFAAHYDLGDEVGRGHFGYTCSARAKKGSFKGQQVAVKIIPKSKMTTAIAIEDVRREVKILRALTGHKNLVQFYDSYEDEENIYVVMELCEGGELLDRILSRGGKYSEEDAKVIMVQILSVVAYCHLQGVVHRDLKPENFLFTSKDETSTLKAIDFGLSDYVKPDERLNDIVGSAYYVAPEVLHRSYGTEADMWSIGVIAYILLCGSRPFWARTESGIFRAVLKADPNFEEAPWPSLSIDAIDFVKRLLNKDYRKRLTAAQALCHPWLADHQDIKIPLDTITFKLVRSYICSSSLRKSALGALAKTLSAVQLGYLQKQFTLLGPNKNGLISMQNFKTALIKNSTEAIKDSRVLDYANVVSSIQYRKLDFEEFCAAAISIYQLEGMESWEQHARHAYDHFDKDGNRPIMIEELASELGLSPSVPVHVVLQDWIRHSDGKLSFLGFVRLLHGVSSRAFQKA

SEQ ID NO: 13389 - protein, 579 aa, Eutrema parvulum
MGLCHGKPIEQQSKKSFPISNETDEEAPKSSLQAAKSSGFPFYSPSTLPSLFKTSPAVSSSSVSSTPLRIFKRPFPPPSPAKHIRALLARRHGSIKPNEASIPEGSECEVGLDKKFGFSKQFASHYEIDGEVGRGHFGYTCSAKGKKGSLKGQDVAVKVIPKSKMTTAIAIEDVRREVKILRALTGHKNLVQFYDAFEDDENVYIVMELCKGGELLDKILQRGGKYSEEDAKNVMVQILSVVAYCHLQGVVHRDLKPENFLFTTKDETSPLKAIDFGLSDYVRPDERLNDIVGSAYYVAPEVLHRTYGTEADMWSIGVIAYILLCGSRPFWARSESGIFRAVLKAEPSFEEAPWPSLSPEAVDFVKRLLNKDYRKRLTAAQALCHPWLAGSHELKIPSDMIIYKLVKVYIMSSSLRKSALSALAKTLTVPQLSYLREQFNLLGPSKNGYISMQNYKTAIMKSSTEATKDSRVLDFVHMISCLQYKKLDFEEFCASALSVYQLEAMETWEQHARRAYELFEKDGNRVIMIEELASELGLGPSVPVQVVLQDWIRHSDGKLSFLGFVRLLHGVSSRTLQKA

SEQ ID NO: 13390 - protein, 576 aa, Eutrema halophilum
MGICHGKPIEQQSRNSLPVSGEVDETPTDSQPAKSSGFPFYSPSPLPSLFKSSPAISSSVSSTPLRIFKRPFPPPSPAKHIRAFLARRSGSTKPNEASIPEGKEFEIGLDKSFGFSKHFASHYEIDGEVGRGHFGYTCSAKGKKGSLKGQEVAVKVIPKSKMTTAIAIEDVSREVKILRALTGHKNLVQFYDAFEDDENVYIVMELCKGGELLDKILQRGGKYSEDDAKKVMVQILSVVAYCHLQGVVHRDLKPENFLFSTKDESSPLKAIDFGLSDYVKPDERLNDIVGSAYYVAPEVLHRTYGTEADMWSIGVIAYILLCGSRPFWARTESGIFRAVLKAEPNFEEAPWPSLSPDAVDFVKRLLNKDYRKRLTAAQALCHPWLVGSHELKIPSDMIIYKLVKVYIMSTSLRKSALAALAKTLTVPQLAYLREQFTLLGPSKNGYISMQNYKTAILKSSTDATKDSRVLDFVHMISCLQYKKLDFEEFCASALSVYQLEAMETWEQHARRAYELFEKDGNRPIMIEELASELGLGPSVPVHVVLQDWIRHSDGKLSFLGFVRLLHGVSSRTLQKA

SEQ ID NO: 13391 - protein, 576 aa, Manihot esculenta
MGLCHGKPIENQNHESNNHTLSIETDSQPTNSHTSKSSNPFYSPSPLPSLFKYSPAISSVSSTPLRIFKRPFPPPSPAKHIRALLARRHGSVKPNEATIPEGNESEIALDKNYGFSKQFVSHYDLGEEVGRGHFGYTCSAKAKKGNMKGQDVAVKVIPKSKMTTAIAIEDVRREVQILRALSGHKNLVQFYDAYEDDENVYVVMELCNGGELLDRILSRGGKYSEDDAKTVMVQILNVVAYCHLQGVVHRDLKPENFLFATKEENSPLKAIDFGLSDYVKPDERLNDIVGSAYYVAPEVLHRSYGTEADMWSIGVIAYILLCGSRPFWARTESGIFRAVLKADPIFDDAPWTSLSPEAIDFVKRLLNKDYRKRLTAAQALSHPWLANHHEIKIPLDMIVYKLVKVYICSSSLRKSALGALAKTLTVAQLAYLREQFTLLGPSKNGFISMSNFKLAVIKNSTDAVKDSRVLDYVSMVSSLQYRKLDFEEFCAAAISVHQLEAMDCWEQHARRAYEFFEKDGNRPIMIEELASELGLGPSVPVHVVLQDWIRHADGKLSFLGFVRLLHGVSSRTFQKA

SEQ ID NO: 13392 - protein, 576 aa, Eutrema halophilum
MGLCHGKPIEHQSKKSLPISSNDTDEEAPKPSKSSGFPFYSPSPLPSLFKTSPAVSSSSVSSTPLRIFKRPFPPPSPAKHIRALLARRHGSIKPNEASIPEGSECDVGLDKKFGFSKQFASHYEIDGEVGRGHFGYTCSAKGKKGSLKGQDVAVKVIPKSKMTTAIAIEDVRREVKILRALTGHKNLIEFYDAFEDDENVYIVMELCKGGELLDKILQRGGKYSEEDAKKVMVQILSVVAYCHLQGVVHRDLKPENFLFTTKDETSPLKAIDFGLSDYVRPDERLNDIVGSAYYVAPEVLHRTYGTEADMWSIGVIAYILLCGSRPFWARSESGIFRAVLKAEPNFEEAPWPSLSPDAVDFVKRLLNKDYRKRLTAAQALCHPWLAGSHELKIPSDMITYRLVKAYIMSSSLRKSALSALAKTLTVPQLAYLREQFNLLGPSKNGYISMQNYKTAILKSSTEATKDSRVLDFVHMISCLQYKKLDFEEFCASALSVYQLEAMETWEQHARRAYELFEKDGNRVIMIEELASELGLGPSVPVQVVLQDWIRHSDGKLSFLGFVRLLHGVSSRTLQKA

SEQ ID NO: 13393 - protein, 577 aa, Arabidopsis thaliana
MGLCHGKPIEQQSKNLPISNEIEETPKNSSQKAKSSGFPFYSPSPLPSLFKTSPAVSSSSVSSTPLRIFKRPFPPPSPAKHIRALLARRHGSVKPNEASIPEGSECEVGLDKKFGFSKQFASHYEIDGEVGRGHFGYTCSAKGKKGSLKGQDVAVKVIPKSKMTTAIAIEDVRREVKILRALTGHKNLVQFYDAFEDDENVYIVMELCQGGELLDKILQRGGKYSEVDAKKVMIQILSVVAYCHLQGVVHRDLKPENFLFTTKDESSPLKAIDFGLSDYVRPDERLNDIVGSAYYVAPEVLHRTYGTEADMWSIGVIAYILLCGSRPFWARSESGIFRAVLKAEPNFEEAPWPSLSPDAVDFVKRLLNKDYRKRLTAAQALCHPWLVGSHELKIPSDMIIYKLVKVYIMSSSLRKSALAALAKTLTVPQLTYLQEQFNLLGPSKNGYISMQNYKTAILKSSTEATKDSRVLDFVHMISCLQYKKLDFEEFCASALSVYQLEAMETWEQHARRAYELYEKDGNRVIMIEELATELGLGPSVPVHVVLQDWIRHSDGKLSFLGFVRLLHGVSSRTLQKA

SEQ ID NO: 13394 - protein, 580 aa, Mimulus guttatus
MGLCHGKPNEPPKNLSENPIIPAESNDPTLNNPSTGKTPKFPFYSPSPLHSAFKNSPANSSSALSTPLRFFKRPFPPPSPAKHIKALLARRHGSVKPNEATIPEGSECEIIGLDKNFGFSKNFVSHYELGEEVGRGHFGYTCYAKGKKGSMKGQDVAVKVIPKSKMTTAIAIEDVRREVKILQALTGHKNLVQFYDAYEDEDNVYAVMELCKGGELLDRILSRGGKYSEEDAKIIMVQILSVVAYCHLQGVVHRDLKPENFLFVTKDEHSSLKAIDFGLSDYVKPDERLNDIVGSAYYVAPEVLHRSYGTEADMWSIGVIAYILLCGSRPFWSRTESGIFRAVIKADPNFEEAPWPTLSLEAIDFVKQLLNKDYRKRLTAAQALCHPWLTGHHEEKIPMDMITYKFVKAYICSTSLRKTALGALARTLTVPQLAYLRDQFAMLGPNKSGFVSLQNFKTAMAKISTDAMKESRVVDYVNVVSSLQYRKLDFEEYCAAAISVHQLEGSEGWEQHARNAYELFEKNGNRPIMIEELASELGLSPSVPVHVVLQDWIRHSDGKLSFLGFVRLLHGVSARTFQKA

SEQ ID NO: 13395 - protein, 576 aa, Aquilegia formosa
MGICHGKQTEAPEIQSENPIIPNDVDVSTNTDTKKASSFPFYSPSPLRNVFKNSPANSSVSSTPLRIFKRPFPPPSPAKHIKALLARRHGSVKPNEASIPEGSEVEVGLDKNFGYLKQFYTKYELGEEVGRGHFGYTCSAVAKKGDLKGQEVAIKVIPKSKMTTAIAIEDVRREVKILRALTGHKNLVQFYDAYEDEDNVYVVMELCKGGELLDRILARGGKYSEEDAKTIMVQILSVVAFCHLQGVVHRDLKPENFLFSSKDEDSSLKAIDFGLSDFVKPDERLNDIVGSAYYVAPEVLHRAYGTEADMWSIGVIAYILLCGSRPFWARTESGIFRAVLKAEPSFEEAPWPSLSSDAKDFVKGLLNKDFRKRFTAAQALSHPWLSSNQVMKIPLDIIIYKFVKAYICSSSLRKSALGALAKTLTVAQLAYFHEQFSLLGPNKSGYISMQNFKTALVKNSTDAMKDSRVLDYANMVSSLHYRKLDFEEFCAAAISVHQLEGMESWEQHARRAYELFEKDGNRAIMIEELASELGLSPSVPVHVVLQDWLRHTDGKLSFLGFVRLLHGLSSRVLQKS

SEQ ID NO: 13396 - protein, 574 aa, Solanum lycopersicum
MGLCHGKPIQSPQNLSENPIIPIDNEQELNSHTGKTPKFPFYSPSPLPSAFKNSPANSSVTSTPLRFLKRVPPSPAKHIRALLARRHGSIKPNEATIPEGSECDIGLDKIFGYSKNFDSHYDLGEEVGRGHFGYTSAAKGKRGSLKGHDVAVKVIPKSKMTTAIAIEDVRREVKILRALTGHRNLVQFYDAYEDEENVYIVMELCKGGELLDRILARGGKYSEDDAKAVMVQLLSVVSYCHLQGVVHRDLKPENFLFVSKDENSPLKAIDFGLSDYVKPDERLNDIVGSAYYVAPEVLHRSYGTEADMWSIGVIAYILLCGSRPFWARTESGIFRAILKTDPNFDEAPWPSLSSDAVDFVKRLLNKDYRKRLTAAQALSHPWLAGHHDVKIPLDMIVYKLVKAYVYSSSLRKTALRALAKTLTIPQLAYLRDQFTLLGPSKSGLVALSNFKMAVMKNSTDAMKDSRVFDFVNTVSSLQYRKLDFEEFCAASISVHQLEGMESWEQHARRGYEFFEKEGNRPIMIEELASELGLSPSVPVHVVLQDWIRHSDGKLSFLGFVRLLHGVSSRTFQKA

SEQ ID NO: 13397 - protein, 577 aa, Eutrema parvulum
MGICHGKPIEHQSKQSIPVSGETDEAPTNSQPPVKSSGFPFYSPSPLPSLFKSSPAISTSASSTPLRIFKRPFPPPSPAKHIRAFLARRNGSTKPNEVSIPEGKEFEIGLDKSFGFSKHFASHYEIDGEVGRGHFGYTCSAKGKKGSLKGQEVAVKVIPKSKMTTAIAIEDVSREVKILRALTGHNNLVQFYDAFEDDENVYIVMELCKGGELLDKILQRGGKYSEDDAKKVMVQILSVVAYCHLQGVVHRDLKPENFLFSTKDETSPLKAIDFGLSDYVKPDERLNDIVGSAYYVAPEVLHRTYGTEADMWSIGVIAYILLCGSRPFWARTESGIFRAVLKAEPNFEEAPWPSLSPDAVDFVKRLLNKDYRKRLTAAQALCHPWLVGSHELKIPSDMIIYKLVKVYIMSTSLRKSALAALAKTLTIPQLAYLREQFTLLGPSKNGYISMQNYKTAILKSSTDATKDSRVFDFVHMISCLQYKKLDFEEFCASALSVHQLEAMETWEQHARRAYELFEKDGNRPIMIEELASELGLGPSVPVHVVLQDWIRHSDGKLSFLGFVRLLHGVSSRTLQKA

SEQ ID NO: 13398 - protein, 576 aa, Arabidopsis thaliana
MGICHGKPVEQQSKSLPVSGETNEAPTNSQPPAKSSGFPFYSPSPVPSLFKSSPSVSSSVSSTPLRIFKRPFPPPSPAKHIRAFLARRYGSVKPNEVSIPEGKECEIGLDKSFGFSKQFASHYEIDGEVGRGHFGYTCSAKGKKGSLKGQEVAVKVIPKSKMTTAIAIEDVSREVKMLRALTGHKNLVQFYDAFEDDENVYIVMELCKGGELLDKILQRGGKYSEDDAKKVMVQILSVVAYCHLQGVVHRDLKPENFLFSTKDETSPLKAIDFGLSDYVKPDERLNDIVGSAYYVAPEVLHRTYGTEADMWSIGVIAYILLCGSRPFWARTESGIFRAVLKAEPNFEEAPWPSLSPEAVDFVKRLLNKDYRKRLTAAQALCHPWLVGSHELKIPSDMIIYKLVKVYIMSTSLRKSALAALAKTLTVPQLAYLREQFTLLGPSKNGYISMQNYKTAILKSSTDAMKDSRVFDFVHMISCLQYKKLDFEEFCASALSVYQLEAMETWEQHARRAYELFEKDGNRPIMIEELASELGLGPSVPVHVVLQDWIRHSDGKLSFLGFVRLLHGVSSRTLQKA

SEQ ID NO: 13399 - protein, 577 aa, Brassica rapa
MGMCHGKPIEHQSKQSLPAPDEPQPPPPPPPAKSSGFPFYSPSPLPSLFKSSPAVSSSASSTPLRIFKRPFPPPSPAKHIRAFLARRHGSSAKPPSEVSIPEGEEFEIGLDKSFGFSKHFASHYEIDGEVGRGHFGYTCSAKGKKGSLKGQEVAVKVIPKSKMTTAIAIEDVSREVKILRALTGHKNLVQFYDAFEDEENVYIVMELCKGGELLDKILQRGGKYSEDDAKQVMVQILSVVAYCHLQGVVHRDLKPENFLFSTKDETSPLKAIDFGLSDYVKPDERLNDIVGSAYYVAPEVLHRTYGTEADMWSIGVIAYILLCGSRPFWARTESGIFRAVLKAEPNFEEAPWPSLSPDAVDFVKRLLNKDYRKRLTAAQALCHPWLVGSHELKIPSDMIIYKLVKVYIMSTSLRKSALQALAKTLTVPQLAYLREQFTLLGPSKNGYISMQNYKTAIVKTATDATKDSRVLDFVHMISCLQYRKLDFEEFCASALSVYQLEAMETWEQHARRAYELFEKDGNRPIMIEELASELGLGPSVPVHVVLQDWIRHSDGKLSFLGFVRLLHGVSSRTLHKA

SEQ ID NO: 13400 - protein, 603 aa, Citrus clementina
MGLCHGKPVENSQNRSQNEALPYENEPQPNSQKSKASYFPFYSPSPLPSLFKNSPAIPSVNSTPLRFFKRPFPPPSPAKHIRSLLARRHGSVKPNEASIPEGNESDIGLDKNFGFSKQFVAHYELGEEVGRGHFGYTCSAKAKKGSLKGQDVAVKVIPKMIGVIFLQVHRPKHENHQFTILDEYCCLFMTTAIAIEDVRREVKILRALTGHKNLVQFYDAYEDDDNIYIVMELCKGGELLDRILSRGGKYSEEDAKIVMVQILSVVAFCHFQGVVHRDLKPENFLFTSKEENSSLKAIDFGLSDYVKPDERLNDIVGSAYYVAPEVLHRSYGTEADMWSIGVIAYILLCGSRPFWARTESGIFRAVLKADPSFDEAPWPSLSPEAIDFVKRLLNKDYRKRLTAAQALSHPWLANSHDVKIPSDMIVYKLIKAYISSSSLRKAALGALAKTLTVPQLAYLREQFTLLGPNKNGFISMQNYKMAVSKNSTDAMKDSRVLDYVNMIGSLQYRKLDFEEFCAAAISVHQLEGMETWEQHARHAYDLFDKDGNRPIMIEELASELGLSPSVPVHVVLQDWIRHSDGKLSFLGFVRLLHGVSSRTFQKA

SEQ ID NO: 13401 - protein, 574 aa, Solanum lycopersicum
MGLCHGKPIQSPQNLSENPIIPIDNEQELNSHTGKTPKFPFYSPSPLPSAFKNSPANSSVTSTPLRFLKRVPPSPAKHIRALLARRHGSIKPNEATIPEGSECDIGLDKIFGYSKNFDSHYDLGEEVGRGHFGYTSAAKGKRGSLKGHDVAVKVIPKSKMTTAIAIEDVRREVKILRALTGHRNLVQFYDAYEDEENVYIVMELCKGGELLDRILARGGKYSEDDAKAVMVQLLSVVSYCHLQGVVHRDLKPENFLFVSKDENSPLKAIDFGLSDYVKPDERLNDIVGSAYYVAPEVLHRSYGTEADMWSIGVIAYILLCGSRPFWARTESGIFRAILKTDPNFDEAPWPSLSSDAVDFVKRLLNKDYRKRLTAAQALSHPWLAGHHDMKIPLDMIVYKLVKAYVYSSSLRKTALRALAKTLTIPQLAYLRDQFTLLGPSKSGLVALPNFKMAVMKNSTDAMKDSRVFDFVNTVSSLQYRKLDFEEFCAASISVHQLEGMESWEQHARRGYEFFEKEGNRPIMIEELASELGLSPSVPVHVVLQDWIRHSDGKLSFLGFVRLLHGVSSRTFQKA

SEQ ID NO: 13402 - protein, 574 aa, Solanum phureja
MGLCHGKPIQSPQNLSENPTIPIDNEQELNSHTGKTPKFPFYSPSPLPSAFKNSPANSSVTSTPLRFLKRVPPSPAKHIRALLARRHGSIKPNEATIPEGSECDIGLDKIFGYSKNFDSHYDLGEEVGRGHFGYTSAAKGKRGSLKGHDVAVKVIPKSKMTTAIAIEDVRREVKILRALTGHRNLVQFYDAYEDEENVYIVMELCKGGELLDRILARGGKYSEDDAKAVMVQLLSVVSYCHLQGVVHRDLKPENFLFVSKDENSPLKAIDFGLSDYVKPDERLNDIVGSAYYVAPEVLHRSYGTEADMWSIGVIAYILLCGSRPFWARTESGIFRAILKTDPNFDESPWPSLSSDAVDFVKRLLNKDYRKRLTAAQALSHPWLAGHHDVKIPLDMIVYKLVKAYVYSSSLRKTALRALAKTLAIPQLAYLRDQFTLLGPSKSGLVALPNFKMAVMKNSTDAMKDSRVFDFVNTVSSLQYRKLDFEEFCAASISVHQLEGMESWEQHARRGYEFFEKEGNRPIMIEELASELGLSPSVPVHVVLQDWIRHSDGKLSFLGFVRLLHGVSSRTFQKA

SEQ ID NO: 13403 - protein, 577 aa, Arabidopsis lyrata
MGICHGKPIEQQQSKSLPVSGETDEAPTNSQPPAKSSGFPFYSPSPVPSLFKSSPSVSSSVSSTPLRIFKRPFPPPSPAKHIRAFLARRYGSVKPNAVSIPEGKECEIGLDKSFGFSKQFASHYEIDGEVGRGHFGYTCSAKGKKGTLKGQEVAVKVIPKSKMTTAIAIEDVSREVKMLRALTGHKNLVQFYDAFEDDENVYIVMELCKGGELLDKILQRGGKYSEDDAKKVMVQILSVVAYCHLQGVVHRDLKPENFLFSTKDETSPLKAIDFGLSDYVKPDERLNDIVGSAYYVAPEVLHRTYGTEADMWSIGVIAYILLCGSRPFWARTESGIFRAVLKAEPNFEEAPWPSLSPDAVDFVKRLLNKDYRKRLTAAQALCHPWLVGSHELKIPSDMIIYKLVKVYIMSTSLRKSALAALAKTLTVPQLAYLQEQFTLLGPSKNGYISMQNYKTAILKSSTDAMKDSRVLDFVHMISCLQYKKLDFEEFCASALSVYQLEATETWEQHARRAYELFEKDGNRPIMIEELASELGLGPSVPVHVVLQDWIRHSDGKLSFLGFVRLLHGVSSRTLQKA

SEQ ID NO: 13404 - protein, 593 aa, Vitis vinifera
MFVVCFNNVASQISKLGWHNLTAGKPIENPQTQSQDLIIPGDGELSTNTQTTKTPKFPFYSPSPLPSGFKNSPANSSVSSTPLRIFKRPFPPPSPAKHIRALLARRHGSVKPNEATIPEGNECEVGLDKNFGFSKQFVAHYEMGEEVGRGHFGYTSSAKAKKGSLKGQDVAVKVIAKSKMTTAIAIEDVRREVKILRALTGHKNLVQFYEAYEDDDNVYVVMELCRGGELLDRILARGGKYSEEDAKAVMVQILNVVAFCHLQGVVHRDLKPENFLFISKEENSPLKAIDFGLSDYVKPDERLNDIVGSAYYVAPEVLHRSYGTEADMWSVGVIAYILLCGSRPFWARTESGIFKAVLKADPSFDEAPWPSLSSDAIDFVKRLLNKDYRKRLTAAQALSHPWLANYHDVKIPLDMIVYKLVKAYIFSSSLRKSALAALAKTLSIAQLAYFREQFTLLGPNKSGFVSLQNFKTAVTKNSTDAIKDSRVLEYVSMVGSLQYRKLDFEEFCAAAISVLQLEGMESWEQHARRGYELFEKDGNRPIMIEELASELGLSPSVPVHVVLQDWIRHSDGKLSFLGFVRLLHGPSRAFPKA

SEQ ID NO: 13405 - protein, 577 aa, Arabidopsis lyrata
MGLCHGKPIEQQSKNLQISNEIEESPKNSSQKAKSSGFPFYSPSPLPSLFKTSPAVSSSSVSSTPLRIFKRPFPPPSPAKHIRALLARRHGFVKPNEASIPEGSECEVGLDKKFGFSKQFASHYEIDGEVGRGHFGYTCSAKGKKGSLKGQDVAVKVIPKSKMTTAIAIEDVRREVKILRALTGHKNLVQFYDAFEDDENVYIVMELCQGGELLDKILQRGGKYSEVDAKKVMVQILSVVAYCHLQGVVHRDLKPENFLFTTKDESSPLKAIDFGLSDYVRPDERLNDIVGSAYYVAPEVLHRTYGTEADMWSIGVIAYILLCGSRPFWARSESGIFRAVLKAEPNFEEAPWPSISPDAVDFVKRLLNKDYRKRLTAAQALCHPWLVGSHELKIPSDMIIYKLVKVYIMSSALRKSALAALAKTLTVPQLTYLQEQFNLLGPSKNGYISMQNYKTAILKSSTEATKDSRVLDFVHMISCLQYKKLDFEEFCASALSVYQLEAMETWEQHARRAYELFEKDGNRVIMIEELATELGLGPSVPVQVVLQDWIRHSDGKLSFLGFVRLLHGVSSRTLQKA

SEQ ID NO: 13406 - protein, 516 aa, Medicago truncatula
MEDHKNQSVSFESPQERRKLPNFLLSVRLKYVKLGYHYLISKAMYLLLIPLFGAASAHLSTISYHDIIQLYENLKFNLVSVTLCTSLMVFLVTLYFMSRPRGVYLVDFACYKPKQEYTCTREIFMNRSELTGTFSDENLAFQKKILERSGLGQKTYLPPAILSVPPNPCMAEARKEAEEVMFGAIDELLEKTGVKAKDIGILVVNCSLFNPTPSLSAMIVNHYKLRGNVQSYNLGGMGCSAGLISIDLAKQLLQVHPNSYALVVSMENITLNWYFGNDRSMLVSNCLFRMGGSAILLSNKASDSKRAKYQLIHTVRTHKGADDRSYGCVFQEEDEKKSIGVSLSKDLMAVAGEALKTNITTLGPLVLPMSEQLLFFATLVARKAFKMKIKPYIPDFKLAFEHFCIHAGGRAVLDELEKNLDLSDWHMEPSRMTLNRFGNTSSSSLWYELAYTEAKGRIRKGDRTWQIAFGSGFKCNSAVWRALRTVDPAKEKNPWMDEIHEFPVHVPKVATIGSSS

SEQ ID NO: 13407 - protein, 514 aa, Cicer arietinum
MADEKNQTVSVESPQEERMKLPNFLLSVKLKYVKLGYHYLISKAMYLFLIPLFGAASAHLSTISYHDVVHLYENLKFNLVSVTLCSSLMVFLVTLYFMSRPRGVYLVDFACYKPKQDYTCTREIFMHRSELTGTFSDENLAFQKKIIERSGLGQKTYLPPAILSVPPNPCMAEARKEAEEVMFGAIDELLEKTGVKAKDIGILIVNCSLFNPTPSLSAMIVNHYKLRGNIQSYNLGGMGCSAGLISIDLAKQLLQVHPNSYALVVSMENITLNWYFGNNRSMLVSNCLFRMGGSAILLSNKTSDSKRAKYQLIHTVRTHKGADDKSYGCVFQEEDDKKTIGVSLSKDLMSVAGEALKTNITTLGPLVLPMSEQLLFFATLVARKVFKMKIKPYIPDFKLAFEHFCIHAGGRAVLDELEKNLDLSDWHMEPSRMTLYRFGNTSSSSLWYELAYAESKGRIRKGDRTWQIAFGSGFKCNSAVWRALRTVDPLQEINPWMDEIHQFPVHVPKVATIT

SEQ ID NO: 13408 - protein, 502 aa, Cicer arietinum
MEEQRNKLPNFLLSVKLKYVKLGYHYLISNAMYLVLIPLLGVVSTHLATFSLKDLIQLWEILKFNFVSVTLCSSLIVFLATLYFMSRPRSIYLVDFACYKPQEDCICTRETFIEKAYLFGQFGDEILSFQKKIVERSGLGQKTYFPSSLMRVPPNYCMEEARKEAEEVMFGAIDELLEKTGVKAKDIGILIVNCSLFNPTPSLSAMVVNHYKLRGNILSYNLGGMGCSAGLISIDLAKHLLQANPNSYALVVSMENITLNLYLGNNRSMLVSNCLFRMGGAAILLSNKPSDRRRSKYQLVHTVRTHKGADDKSYGCVFQKEDDTKKVGVALSKDLMAVAGEALKTNITTLGPLVLPMSEQLLFFVTLVGRKIFKMKIKPYIPDFKLAFEHFCIHAGGRAVLDELEKNLDLSEWHMEPSRMTLYRFGNTSSSSLWYELAYTEAKGRIKKGDRTWQIAFGSGFKCNSAVWKALKTINPEKEKSPWIDEIHEFPVHVPQVAKIDS

SEQ ID NO: 13409 - protein, 129 aa, Vigna unguiculata
MGRFFVMELEGRSYRCKFCSTHLALADDLISRLFHCRRGKAYLFNNVVNFTLGAPEERQMLSGLHTVADIFCCCCGQIIGWKYESAHEKSQKYKEGKFVLERGRIVDEVEFSTEFYIDSRVCVSDGDEA

SEQ ID NO: 13410 - protein, 129 aa, Glycine max
MGRIFVVELEGRSYRCKFCRTHLALADDLISRAFHCRRGKAYLFNNAVNFTIGTPEERMMLSGLHTVADIFCCCCGQIIGWKYESAHEKSQKYKEGKFVLERGRIVDEVDFSTEFYIDSHASMSDAEEP

SEQ ID NO: 13411 - protein, 129 aa, Cajanus cajan
MGRIFTVELEGRSYRCKFCRTHLALADDLISRAFHCRRGKAYLFNNAVNFTIGASEERMMLSGLHTVADIFCCCCGQIIGWKYESAHEKSQKYKEGKFVLERGRIVDEVDFSAEFYIDSRACMSDTEDA

SEQ ID NO: 13412 - protein, 128 aa, Arachis hypogaea
MGRVFVVELEGRSYRCKFCKTHLALADDLISRAFHCRRGKAYLFNNAVNFTMGVLEERMMLSGLHTVADIFCCCCGQIIGWKYESAHEKSQKYKEGKFVLERGRIVDEIDFSTEFYIDTRASMSDGED

SEQ ID NO: 13413 - protein, 129 aa, Glycine max
MGRIFAVELEGRSYRCKFCRTHLALANDLISRAFHCLRGKAYLFNNVVNFTIGTPEERMMLSGLHTVADIFCCCCGEIIGWKYESAHEKCQKYKEGKFVLERGRIVDEVDFSTEFYIDSHASMSDAEEP

SEQ ID NO: 13414 - protein, 126 aa, Glycyrrhiza uralensis
MGRIFVVELEGRSYRCKFCRTHLALVDDLISRAFHCRRGKAYLFNNAVNTTVGAPEERMMLSGLHTVADIFCCCCGQIIGWKYESAHEKSQKYKEGKFVLERGRIVDDVDFSAEFYIDSHASMSDA

SEQ ID NO: 13415 - protein, 129 aa, Medicago truncatula
MGRIFVVELEGRSYRCKFCRTHLALADDLISRAFHCRRGNAYLFSKAVNTTTGTPVERMMLSGLHTVTDIFCCCCGQIVGWKYESAHEKSQKYKEGKFVLERGRIVDDVDSSTEFYIDSHVSMSDGEDA

SEQ ID NO: 13416 - protein, 129 aa, Trigonella foenum-graecum
MGRIFVVELEGRSYRCKFCRTHLALANHLISRAFHCRRGKAYLFTNAVNTTTGTPEERMMLSGLHTVADIFCCCCGQIVGWKYESAHEKNQKYKEGKFVLERGRIVDDIDFSTEFFIDSHASMSDGEYA

SEQ ID NO: 13417 - protein, 124 aa, Cyamopsis tetragonoloba
LLELEGRSYRCKFCKTHLALAEDLISRAFHCRRGKAYLFNNTVNVTIGASEERMMLSGLHTVADIFCCSCGQIIGWKYESAHEKSQKYKEGKFVLERGRIIDEVDFSTDFYIDSRASMSDAEDA

SEQ ID NO: 13418 - protein, 129 aa, Gossypium raimondii
MGRIFVVELDGRSYRCKFCRTHLALPDDLVSRSFHCRRGKAYLFNNAVNITVGALEERVMLSGMHTVADIFCCCCGQIVGWKYEAAHEKSQKYKEGKFVLERGRIVDEIDFSSEVYIDTRPSMSDGEDA

SEQ ID NO: 13419 - protein, 129 aa, Lotus japonicus
MGRIFAVELEGRSYGCKSCKTHLALADDLISRGFYCQRGKAYLFNNVVNFTIGELEERAMLSGLHTVADIFCCCCGQIIGWKYESAHEKSQKYKEGKFVLERGRIVDEIDFSTEFRVDSCISMSDSEDA

SEQ ID NO: 13420 - protein, 129 aa, Castanea mollissima
MGRIFVVELEGRSYRCKFCKTHLALAEDLVSRAFHCRRGKAYLFNNAVNLIVGALEERLMLSGLHTVADIFCCCCGQIVGWKYEAAHERSQKYKEGKFVLERGRIVDEVDFATEFYIDTRPSMSDAEDA

SEQ ID NO: 13421 - protein, 128 aa, Gossypium hirsutum
GRIFVVELDGRSYRCKFCRTHLALPDDLVSRSFHCRRGKAYLFNNAVNITVGALEERVMLSGMHTVADIFCCCCGQIVGWKYEAAHEKSQKYKEGKFVLERGRIVDEIDFSSEVYIDTRPSMSDGEDA

SEQ ID NO: 13422 - protein, 133 aa, Tropaeolum majus
MGRIFVVELEGRSYRCKFCRTHLALPDDLVSRAFHCRRGKAYLFNKAVNISMGVLEERMMLSGMHTVADIYCCCCGQIIGWKYESAHEKSQKYKEGKFVLERGRIVDEIDFSTEVYIDTHLSMSDADADANDA

SEQ ID NO: 13423 - protein, 130 aa, Lupinus angustifolius
MGRIFTVELEGRSYGCKFCKTHLALADDLISRAFYCQRGKAYLFNNVVNFTIGELEERLMLSGLHTVADIFCCCCGQIIGWKYEFAHEKSQKYKEGKFVLERGRIVDGIDFSAAEFFIESRANMSDAEDA

SEQ ID NO: 13424 - protein, 130 aa, Prunus persica
MGRIFVVELEGRCYKCKFCKTHLALVSDCVSRSFHCRRGKAYLFNNAVNTTIGALEERLMLSGLHTVADIFCCCCGQIVGWKYESAHEKSQKYKEGKFVLERGRIVDEVDFSTEFFVDSRPSMSSDADDV

SEQ ID NO: 13425 - protein, 129 aa, Phaseolus vulgaris
MGRIFTVELEGRSYGCKSCKTHLALADDLISRAFYCQRGKAYLFNNVVNFTIGVLEERMMLSGLHTVADIFCCCCGQIVGWKYESAHERSQKYKEGKFVLERGRIVDEIDFSAEFHIESCVSMSDAEDA

SEQ ID NO: 13426 - protein, 129 aa, Euphorbia peplus
MGRIFAVELEGRSYRCKFCSTHLALPLDLVSRSFHCRRGKAYLFNSVVNITVGAIEERMMLSGLHTVADIFCCSCGQILGWKYEAAHEKGQKYKEGKFVLERGRIVDEMDLSPGIFIDSRTGMSDGEDA

SEQ ID NO: 13427 - protein, 129 aa, Heritiera littoralis
MGRIFVVELDGRSYRCRFCKTHLALPDDLVSRSFHCRRGKAYLFNNVVNITVGVLEERLMLSGMHTVADIFCCCCGQIVGWKYEAAHEKTQKYKEGKFVLERGRIVDEIDFSSEVYIDTRPSMSDGEDA

SEQ ID NO: 13428 - protein, 129 aa, Quercus alba
MGRIFVVELEGRSYRCKFCKTHLALAEDLVSRAFHCRRGKAYLFNNAVNLIVGALEERLMLSGLHTVADIFCCCCGQIVGWKYEAAHERGQKYKEGKFVLERGRIVDEVDFATEFYIDTRPSMSDAEDA

SEQ ID NO: 13429 - protein, 129 aa, Glycine max
MGRIFTVELEGRSYSCKSCKTHLALADDLISRSFYCQRGKAYLFNNVVNFTIGELEERLMLSGLHTVADIFCCCCGQIVGWKYESAHERNQKYKEGKFVLERGRIVDEMDFSTEFRIESCVSMSDAENA

SEQ ID NO: 13430 - protein, 130 aa, Carpinus betulus
MGRLFVVELEGRSYRCKFCKTHLALADDLVSRGFHCRRGKAYLFNNAVNLIVGALEERMMLSGLHTVADIFCCCCGQIVGWKYDAAHERSQKYKEGKFVLERGRIVDEIDFSNEFYIDTRPSVMSDAEDV

SEQ ID NO: 13431 - protein, 130 aa, Prunus mume
MGRLFVVELEGRCYKCKFCKTHLALVSDCVSRGFHCRRGKAYLFNNAVNTTIGALEERLMLSGLHTVADIFCCCCGQIVGWKYESAHEKSQKYKEGKFVLERGRIVDEVDFSTEFFVDSRPSMSSDADDV

SEQ ID NO: 13432 - protein, 287 aa, Vigna unguiculata
MEDAVAVIPGFMSRTCDHVGGCTAPGSRSSGEISPVHFFGVYDGHGGSQVAKFCAKRMHDVIAEEWNREMAGGAEWQRRWETVFANSFERTDNEILSDAVAPEMVGSTASVVVLSGCQIIASNCGDSRVVLCRRTQTIPLSVDQKPDRQDELLRIEGEGGKVINWNGARVFGVLAMSRAIGDRYLRPWIIPVPEITFTARTDEDECLILASDGLWDVMSNEEVGEVARHILRRRRRSLSVEEPSPAQVVADSLTEIAYGRNSKDNISIIVVDLKSKRKRQQRPPLIS

SEQ ID NO: 13433 - protein, 425 aa, Cajanus cajan
LHSQFTIDACAINKTYIFLTRVAVSPLLSAPFIASSLLFLPPSSLSALSTTTPFAMEEDEQLERFHSEFASTSSGSAISSTDDFRNLTSSGDISSISSGSGEIPPVAALAPPPRDKCVGRTNKGVSWGHTSVIGRRKEMEDAVAVIPGFMSRTCYHVGGCTAPGSRSSCEIAPLHFFGVYDGHGGSQVAKFCAKRMHDVIAEEWDREMASAAEWQRRWETVFANSFDRTDNEILSDTVAPEMVGSTASVVVLSGCQIITSNCGDSRVVLCRRTQTIPLTVDQKPDRQDELLRIEGGGGKVINWNGARVFGVLAMSRAIGDRYLRPWIIPVPEITFTARTDEDECLILASDGLWDVMTNEEVGEVARHILRRRRRSLSMEEKSPAQVVADSLTEIAYGRNSKDNISIIVVDLKSKRKRQQRPSLIS

SEQ ID NO: 13434 - protein, 445 aa, Glycine max
PSFPTHKFTIDACAINKTYIFLTRVVFSSLLLSSPLLASFSSPLNSQLRHQYRCCCCCSCVMDEDEQLERFDSEFASTSSISSTLSTDDFRNLTSSGDISSISSGSGEIPPVSVLAPPFLHCEGSNDGETAAAREKCVGRSNKGVSWGHTSVIGRRKEMEDAVAVIPGFMSRTCDHIGGCTAPGSRSSGEIAPVHFFGVYDGHGGSQVAKFCAKRMHDVIAEEWDREMEGGARWHRRWETVFANSFERTDNEILSDAVAPEMVGSTASVVILSGCQIITSNCGDSRVVLYRRTQTIPLTVDQKPDRQDELLRIEGGGGRVINWNGARVFGVLAMSRAIGDRYLRPWIIPVPEITFTARTDEDECLVLASDGLWDVMTNEEVGEVARHILRRRRRSLSMEEASPAQVVADSLTEIALGRNSKDNISIIVVDLKSKRKRQQRPPLIS

SEQ ID NO: 13435 - protein, 384 aa, Glycine max
MDEDEQLERFDSEFASTSSISSTLSTDDFRNLTSSGDISSISSGSGEIPPVSVLAPPFLHCEGSNDGETAAAREKCVGRSNKGVSWGHTSVIGRRKEMEDAVAVIPGFMSRTCDHIGGCTAPGSRSSGEIAPVHFFGVYDGHGGSQVAKFCAKRMHDVIAEEWDREMEGGARWHRRWETVFANSFERTDNEILSDAVAPEMVGSTASVVILSGCQIITSNCGDSRVVLYRRTQTIPLTVDQKPDRQDELLRIEGGGGRVINWNGARVFGVLAMSRAIGDRYLRPWIIPVPEITFTARTDEDECLVLASDGLWDVMTNEEVGEVARHILRRRRRSLSMEEASPAQVVADSLTEIALGRNSKDNISIIVVDLKSKRKRQQRPPLIS

SEQ ID NO: 13436 - protein, 385 aa, Glycine max
MDEDEQLERFDSEFASTSSISSTLSTDDFRNLTSSGDISSISSGSGEIPPVAVLAPPFLYREGSNDVETAPAPREKCVGRSNKGVSWGHTSVIGRRKEMEDAIAVIPGFMSRTCDRVGGCTAPGSRSSGEIAPLHFFGVYDGHGGSQVAKFCAKRMHDVIAEEWDREIGGAAEWQRRWEAVFANSFERTDNEILSDAVAPEMVGSTASVVVLSGCQIITSNCGDSRVVLCRRTQTIPLTVDQKPDRQDELLRIEGGGGKVINWNGARVFGVLAMSRAIGDRYLRPWIIPVPEITFTARTDEDECLVLASDGLWDVMTNEEVGEVARRILRRRRRSLSMEETSPAQVVAESLTEIAYGRNSKDNISIIVVDLKSKRKRQQRPPLIS

SEQ ID NO: 13437 - protein, 397 aa, Cicer arietinum
MEPLDDAESQLERIDSELTSTSSGSGISSVFSADDFRNFNSSGDISSISSGSGEIPSFTVNRVILAPPLSAASNEADNEAAVPAVREKCVGRNNKGVSWGHTSVIGRRKEMEDAVAVIPGFMSRTCDHVGGCTAPGSRSSGEIGPVHFFGVYDGHGGSEVAKFCAKRMHDVIAEEWDREIEGGAEWQRRWEAVFANGFEKTDNEIESDAVAPEMVGSTASVVVLSGCQIITSNCGDSRVVLCRRTQTLPLTVDQKPDREDELLRIEGEGGKVIHWNGARVFGVLAMSRAIGDRYLRPWIIPVPEITFTARTDEDECLILASDGLWDVMTNEEVGDIARHILRRRRRSLSMEEISPAQVVADSLTEIAYSRNSKDNISIIVVDLKSKRKRLQRPPSIS

SEQ ID NO: 13438 - protein, 372 aa, Lupinus angustifolius
MEPSQDDQHERVDSEFTSTSSGSGISSILSIDDLRNMTITSSEVSSISSGGSGEIPPMTREKCVGRKNKGVSWGQSSVIGRRKEMEDAVAVIPGFMSRMCDHVGGCTAPGSRSSDEISPVHFFGVYDGHGGSQVAKFCAKRMHLVIAEECDKEMAGGTEWQRRWEAVFAKGFERTDTEVLLDAVAPEMVGSTASVVVLSGCQIITSNCGDSRVVLCRRTQTIPLTVDQKPDRQDELLRIEGTGGKVINWNGARVFGVLAMSRAIGDRYLRPWIIPVPEITFTARTEEDECLVLASDGLWDVMTNDEVGEVARHILRRRRRLSLSTEEISPAQVVADSLTEIAYGRNSEDNISIIVVDLKSKRRRQLRPPLVS

SEQ ID NO: 13439 - protein, 396 aa, Lotus japonicus
LHSCCSCVMESESEDGQLDRVDSELTSTTSISTISSILTSDDSFNFTSSGDISSSSSGSGEIPGLSVLAPLLPASSPSEDAAVVREKCVGRSNKGVSWGHTSVIGRRKEMEDAVAVVPGFMSSTCNHIGGCTAPGSRSSGEISPIHFFGVYDGHGGSQVAKFCAKRMHDVVAEEWGREMAAAGGAEWQRNWEAVIANGFERTDNEIKSDEVAPEMVGSTASVVVLSGCQIITSNCGDSRVVLCRRTQSIPLTVDQKPDRQDELLRIEGEGGKVINWNGARVFGVLAMSRAIGDWYLRPWIIPVPEITFTERTDEDECLVLASDGLWDVMTNEEVGEVARHILRRRRRSLSTTEEISPAQVVADSLTEIACGRNSKDNISIIVVDLKSKGKRQQRPP

SEQ ID NO: 13440 - protein, 406 aa, Arachis hypogaea
ALSHCRCIMDEEEQLQRHDSELSTISSSSGISSILSFDDFRGSNTSSGDISSISSGSGEIPPADAILLPPLLRRTVSSDVEVVVAAAVRDKCVGRKNKGVSWGHTSVIGRRKEMEDAVAVIPGFMSRTCHHVGGCTAPGSQSSGEISPLHFFGVYDGHGGSQVAKFCANRMHDVIAEEWERQIESYSEWQRRWEAVFSNGFERTDNEISSDEVAPEMVGSTASVVVLSGCQIITSNCGDSRVVLCRRAQTIPLTVDQKPDRQDELLRIEGGGGKVINWNGARVFGVLAMSRAIGDRYLRPWIIPVPEITFTARSEEDECLILASDGLWDVMTNEEVGEVARHILRRRRRSLSLEEISPAQVVANSLTEIAYARNSKDNISIIVVDLKSKRKRQPRPPLVAREANYI

SEQ ID NO: 13441 - protein, 404 aa, Fragaria vesca
LLLPLSPPPSYFISHSLASFLSSSSLFFSLSFRMDEPQLGRVDSLDLASTSSSGLSSILTSDDSRSTTSSSGEFSRTTAGSSGEIPALLAVPEARPKCVGRNNKGVTWGSTAVIGRRKEMEDAVAVIPGFMACTCDHVGGCTAPGSRTSSEISPVHFFGVYDGHGGSQVAKFCAERMHEVIAQEWDKEMVDGCEWQRRWETTFLVGFERADSEVLTEADAPEMVGSTAVVVVLSGCQIITSNCGDSRAILCRGTETIPLTVDQKPDREDELIRIEGEGGRVINWNGARVFGVLAMSRAIGDRYLRPWIIPVPEITFTARTDEDECLILASDGLWDVMTNEEVGEVARHILRRRRRSMFTNTEEISAAQAVADHLTEIAYGRNSSDNISIIVVDLKMKRKRQPRQ

SEQ ID NO: 13442 - protein, 394 aa, Citrus clementina
MEPLSEREEEQLERFDLVADTDLASASSGLSFVLSTDDSRSTTSSGDISASSGEIPAILVEETVVPRLVDPIPSIGELTVAVTPTARLMCVGRDNKGVTWGLTSVIGRRREMEDAVTVMPGFMSCTCDHVGGCTAPGSRSCGEISPIHFFGVYDGHGGSQVAKFCAERMHEVIAEEWDRERVCSDWQRRWEVAFSSGFERTDNEVLTEAAAPEMVGSTAVVVVLSGCQIITSNCGDSRAVLCRGTETIPLTVDQKPDRQDELERIEGAGGRVINWNGARVFGVLAMSRAIGDRYLRPCIIPVPEITFTTRTDEDECLILASDGLWDVMTNEEVGEVARRLLRRRRRSLLVDEVSPAQVVADNLTEIAYGRNSSDNISIIVVDLKAKKKRQQRQQ

SEQ ID NO: 13443 - protein, 394 aa, Citrus sinensis
MEPLSEREEEQLERFDLVADTDLASASSGLSFVLSTDDSRSTTSSGDISASSGEIPAILVEETVVPRLVDPIPSIGELTVAVTPTARLMCVGRDNKGVTWGLTSVIGRRREMEDAVTVMPGFMSRTCDHVGGCTAPGSRSCGEISPIHFFGVYDGHGGSQVAKFCAERMHEVIAEEWDRERVCSDWQRRWEVAFSSGFERTDNEVLTEAAAPEMVGSTAVVVVLSGCQIITSNCGDSRAVLCRGTETIPLTVDQKPDRQDELERIEGAGGRVINWNGARVFGVLAMSRAIGDRYLRPCIIPVPEITFTTRTDEDECLILASDGLWDVMTNEEVGEVARRLLRRRRRSLLVDEVSPAQVVADNLTEIAYGRNSSDNISIIVVDLKAKKKRQQRQQ

SEQ ID NO: 13444 - protein, 428 aa, Eucalyptus grandis
MRENRRGEEREGFRRSDYISELMEQPEEEEQLESFDSESSGALSILTITEDPTSASSSGDLCSSSGPGSSGGSSGEIPACAEEAAAAAPSLLAAEPARPREEGLAGSTEADAAAAAAGKRKCVGRSNRGVAWGSTSIIGRRKEMEDAVAVVPGFMSRACDHVGGCLAPGSRISGEISPVHFFGVYDGHGGAQVANFCAARMHEVIAEEWNREVMDGFEWQRRWEAAFSTGFERADSEVMTEAAAPEMVGSTAVVVILSGCQIIASNCGDSRAILCRGTQTIPLTVDQKPDRHDELMRIEGMGGKVINWNGARVFGVLAMSRAIGDRYLRPWIIPVPEITFTTRVDEDECLILASDGLWDVMTNDEVGEVARRLLRRRRRLMVDEISPAQAIANYLTETAYGRNSSDNISIIVVDLKAKRKRQQRPQEG

SEQ ID NO: 13445 - protein, 116 aa, Vigna unguiculata
MEGVVKFACVVGFVVLVSIAKVDSAGECGKSTTPDNEAIKLIPCASAAQDENASVSQSCCAQVKKIGQNPSCLCAVLLSNTAKMAGVNPQIAITIPKRCNLANRPVGYKCGPYTLP

SEQ ID NO: 13446 - protein, 118 aa, Glycine max
MEGCVKKLLCLVGFVVLVSTIGGVESAGECGKSTTPDNEAYKLAPCASAAQDENASVSQSCCAQVKKIGQNPSCLCAVLLSNTAKMAGVNPQVAVTIPKRCNLANRPVGYKCGPYTLP

SEQ ID NO: 13447 - protein, 120 aa, Glycine max
MEGCTYCVKLLCLVGFVVLVSTIAGVESAGECGKSTTPDNEAYKLAPCASAAQDENASVSQSCCAQVKKIGQNPSCLCAVLLSNTAKMAGVNPQVAVTIPKRCNLANRPVGYKCGPYTLP

SEQ ID NO: 13448 - protein, 112 aa, Helianthus annuus
KLLCLVGFVVLVSTIAGVESAGECGKSTTPDNEAYKLAPCASAAQDENASVSQSCCAQVKKIGQNPSCLCAVLLSNTAKMAGVNPQVAVTIPKRCNLANRPVGYKCGPYTLP

SEQ ID NO: 13449 - protein, 116 aa, Cicer arietinum
METLVKFVCLIGFVVLVSVASVESAGECGKSTTPDNEAFKLAPCASAAQDENASVSQSCCAQVKKLGQNPSCLCAVMLSNTAKMSGADPQIAVTIPKRCNIATRPVGYKCGPYTLP

SEQ ID NO: 13450 - protein, 63 aa, Cicer arietinum
METLVKFVCLIAFVVLVSVASVESAGECGKSTTPDNEAFKLAPCASAAQDEKCKCVTKLLCSG

SEQ ID NO: 13451 - protein, 116 aa, Cicer arietinum
METLVKFVCLIAFVVLVSVASVESAGECGKSTTPDNEAFKLAPCASAAQDENASVSQSCCAQVKKLGQNPSCLCAVMLSNTAKMSGADPQIAVTIPKRCNIATRPVGYKCGPYTLP

SEQ ID NO: 13452 - protein, 120 aa, Glycyrrhiza uralensis
MEAPMKLLCLVGFVVLVSVAAGVNRVEGAGECGKSTTPDNEAFKLAPCASAAQDENASVSQSCCAQVKKLGQNPSCLCAVMLSNTAKMSGVNPQIAVTIPKRCNIANRPVGYKCGPYTLP

SEQ ID NO: 13453 - protein, 117 aa, Medicago truncatula
MEGLMKMLCLVGFVVLVAGIHSVESAGECGRGTTPDMEAFKLAPCASAAQDENASVSQTCCAQTKKLGQNPSCLCAVLLSNVAKMSGVNPQIAVTIPKRCNFANRPVGYKCGPYTLP

SEQ ID NO: 13454 - protein, 117 aa, Cajanus cajan
MEGCVKLVWVVGLVVLLVSVARVDSAGECGKSTSPDAEAIKLAPCGSAAQDESASVSQSCCAQVKKMGQNPSCLCAVLLSNTAKMSGVDPKIAITIPKRCNLANRPVGYKCGPYTLP

SEQ ID NO: 13455 - protein, 117 aa, Trigonella foenum-graecum
MEGLMKMLCLVGFVVLVAGIHRAESAGECGRGTTPDNEAFKLAPCANAAQDENASVSQSCCAQVKKLGQNPSCLCAVMLSNVAKMSGANPQIAVTIPKRCNLANRPVGYKCGPYTLP

SEQ ID NO: 13456 - protein, 92 aa, Cicer arietinum
METLVKFVCLMSLLYLLVLQVWKVLVNVGKSTTPDNEVFKLAPCASAAQDRNASVSQSCCAQVKKLGQNPSCYVLLCYQTLPKCLVLTLKLL

SEQ ID NO: 13457 - protein, 565 aa, Glycine max
MWRRSFSSSTAATTATLKGKKWDALIIGGGHNGLTAAAYLARGGLSVAVLERRHVIGGAAVTEELVPGFKFSRCSYLQSLLRPSVIKELELGKHGLKLLKRNPSSFTPCLDGRYLLLGPDKDLNHSEISKFSLADAQAYPRYESQLESFCKFMDLVLDSPPPESVHHKSSINEKLKNKIQNSVFWASCLRQVSSLGQKDMVNFMDLLLSPASKVLNNWFETDVLKATLATDAVIGSTASVHTPGSGYVLLHHVMGETDGERGIWSYVEGGMGSISKAIGNAAIEAGAHVVTNAEVSRLLIENTSTVCGVTLADGTEVHSSIVLSNATPYKTFMELVPNDILPDDFVRAIKHSDYSSATTKLNVAVDKLPEFRCCKLDHPHAGPQHVGTIHIGSESMEEIHSACQDAVNGVPSRRPVIEMTIPSVLDKTISPPGKHVINLFVQYTPYKPLDGDWQDHDYRESFAQKCFKLIDEYAPGFSTSIIGYDMLTPPDLEREIGLTGGNIFHGAMGLDSLFLMRPAKGWSNYKTPLRGLYLCGSGAHPGGGVMGAPGRNAARLVLQEVGERT

SEQ ID NO: 13458 - protein, 561 aa, Glycine max
MWRRSFSSSTAALKGKKWDALVIGGGHNGLTAAAYLARGGLSVAILERRHVIGGAAVTEELVPGFKFSRCSYLQSLLRPSVIKELELGKHGLKLLKSNPSSFTPCLDGRYLLLGPDKDLNHSEISKFSLKDAQAYPRYQTQLESFCKFMDLVLDSPPPESVHHKSSINEKLKNKLQNSVFWASCLRQVSSLGQKDMVDFMDLLLSPASKVLNNWFEADVLKATLATDAVIGSTASVHTPGSGYVLLHHVMGETDGERGIWSYVEGGMGSISKAIGNAAIEAGAHVVTNAEVSRLLIENSSTVCGVALADGTEVHSSIVLSNATPYKTFMELVSNDVLPDDFVRAIKHTDYSSATTKINVAVDKLPEFHCCKLEHPHAGPQHVATIHIGSESMEEIHSACQDAVNGVPSRRPVIEMSIPSILDKTISPPGKHVINLFVQYTPYKPLDGDWQDHDYRESFAQKCFTLIDEYAPGFSTSVIGYDMLTPPDLEREIGLTGGNIFHGAMGLDSLFLMRPAKGWSNYKTPLKGLYLCGSGAHPGGGVMGAPGRNAARLVLQEVGERT

SEQ ID NO: 13459 - protein, 563 aa, Cajanus cajan
MWRRSFSSSSGSTALKAKKWDALIIGGGHNGLTAAAYLARGGLSVAVLERRHVIGGAAVTEELVPGFKFSRCSYLQSLLRPSVIKELELEKHGLKLLKRNPSSFTPCLDGRYLLMGADEHLNHSEISKFSLTDAEAYPRYASQLEKFCKFMDLVLDSPPPESVQHKSSINEKLKNKIQNSVFWANCLRQVSSLGQKDLVDFMDLLLSPASKVLNNWFEADVLKATLATDAVIGSTASVHTPGSGYVLLHHVMGESDGERGVWSYVEGGMGSISKAIGNAAIRAGAHIVTNAEVAGLLIENSRTVCGVILADGTEVHSSIVLSNATPYKTFMEFVPNNVLPDDFVRAIKHSDYSSATTKINVAVDKLPQFPCCKLNHPHAGPQHVGTIHIGSESMEEIHSACQDAVNGIPSRRPVIEMTIPSALDKTISPPGKHVINLFVQYTPYKPLDGDWQDHDYRESFAQKCFTLIDEYAPGFSTSIIGYDMLTPPDLEREIGLTGGNIFHGAMGLDSLFLMRPAKGWSNYKTPLQGLYLCGSGAHPGGGVMGAPGRNAARLVLQDVGERT

SEQ ID NO: 13460 - protein, 564 aa, Medicago truncatula
MWRRKFTTTISGSAAALTDKKWDALIIGGGHNGLTAAAYLARGGLSVAVLERRHIIGGAAVTEELIPGFKFSRCSYLQSLLRPAVINELELAKHGLKLLKRNPSSFTPCLDGRYLLLGPDKDLNHSQISKFSKADADAYPKYESQLETFCKFMDLVLDSSPPESLQHKSSLNEQLKNKLQNSVFWASCLRHAASMGQKDMVDFMDLLLSPASKVLNNWFEADVLKATLATDAVIGSTASVHTPGSGYVLLHHVMGESDGERGIWSYVEGGMGSISKAIASAAVAAGAHVATNAEVSQLLIKNSSTVSGVILADGTEVHASVVLSNATPYKTFMDLVPNNVLPDDFSRAIKHSDYSSATTKINVAVDKLPQFQCCKSNHSQAGPEHVGTIHIGSESMEEIHSASQDSVNGIPSRRPVIEMTIPSVLDKTISPPGMHVINLFVQYTPYKPSDGDWQDHEYRESFAQKCFTLIDEYAPGFSTSVVGYDMLTPPDLEREIGLTGGNIFHGAMGLDSLFLMRPVKGWSNYKTPLKGLYLCGSGAHPGGGVMGAPGRNAAHLVLQDIRKT

SEQ ID NO: 13461 - protein, 564 aa, Trigonella foenum-graecum
MWRRRFSTTVSGSAASLTDKKWDALIIGGGHNGLTAAAYLARGGLSVAVLERRHIIGGAAVTEELIPGFKFSRCSYLQSLLRPAVINELELAKHGLKLLKRNPSSFTPCLDGRYLLLGPDKDLNHSQISKFSKNDAEAYPKYESQLENFCKFMDLVLDSSPPEALQHKSSLNEQLKNKLQNSVFWASCLRHAASMGQKDMVDFMDLLLSPASKVLNNWFEADVLKATLATDAVIGSTASVHTPGSGYVLLHHVMGESDGERGIWSYVEGGMGSISKAIASAAVAAGAHVATNAEVSQLLIKNSSTVSGVILADGTEVHASVVLSNATPYKTFMDLVPNNVLPDDFSRAIKHSDYSSATTKINVAVDKLPQFQCIKSDHSHAGPEHVGTIHIGSESMEEIHAASEDAVNGIPSRRPVIEMTIPSVLDKTISPPGMHVINLFVQYTPYKPLDGDWQDREYRESFAQKCFTLIDEYAPGFSTSVVGYDMLTPPDLEREIGLTGGNIFHGAMGLDSLFLMRPVKGWSNYKTPLKGLYLCGSGAHPGGGVMGAPGRNAAHVVLQDVRKT

SEQ ID NO: 13462 - protein, 564 aa, Cicer arietinum
MWRRKFTTTVSGSASSLKDKKWDALIIGGGHNGLTAAAYLARGGLSVAVLERRYIIGGAAVTEELIPGFKFSRCSYLQSLLRPAVINELELAKHGLKLLKRNPASFTPCLDGRYLILGPDKDVNHSQISKFSQADADAYPIYESKLENFCKFMDLVLDSAPPESLQHKSSLNEQLKSKLQNSVFWASCLQQAACMGQKDMVDFMDLLLSPASKALNNWFETDVLKATLATDAVIGSTASVHTPGSGYVLLHHVMGETDGDRGIWSYVEGGMGSISKAIASAATTAGAHIVTNAEVSQLLIKNSSTVCGVILADGTEVHASVVLSNATPYKTFMELVPNNVLPDDYFGAIKHSDYSSATTKINVAVDKLPQFQCCKSNHSHAGPEHVGTIHIGSESMEEIHSASQDAVNGIPSRRPIIEMTIPSVLDKTISPPGKHVINLFVQYTPYKPLDGDWQDHDYRESFARRCFTLIDEYAPGFSTSVIGYDMLTPPDLEREIGLTGGNIFHGAMGLDSLFLMRPVKGWSNYKTPLKGLYLCGSGAHPGGGVMGAPGRNAAHLVLRDIRKT

SEQ ID NO: 13463 - protein, 563 aa, Populus trichocarpa
MWRRSFSTATNASTALKEKKWDALVIGAGHNGLTAAAYLAGSGLSVAVLERRHVIGGAAVTEELIPGFKFSRCSYLQSLLRPSLIKELELGRHGLKLLKRSPSSFTPCLDGSYLLLGPDRELNHSEISKFSVNDANAYHRYEKQLESFCKLMDPLLDSPPPETAQNGASFNDRLKDKLRKSAFWASFMRQALSLGQKDLVDFMDLLLSPASKVLNKWFETDVLKATLATDAVIGSTASVHTPGSGYVLLHHVMGETDGERGIWSYVEGGMGSVSSAIANAARESGAHIVTSAEVSQLMIKDSGTVNGVLLADGTEVLSPIVLSNATPYKTFLELVPNNTLPDDFTRALKYSDYSSATTKINLAVDKLPQFQCCKLNHPDAGPQHVGTIHIGSESMEEIDLACQDAVNGVPSRRPVIEMTIPSVLDKTISPPGKHVINLFVQYTPYKPSDGSWGDSAYRESFAQKCFSLIEEYAPGFSSSIIGYDMLTPPDLEREIGLTGGNIFHGAMGLDSLFLMRPVKGWSSYRTPLQGLYLCGSGTHPGGGVMGAPGRNAAHVVLQDVEKP

SEQ ID NO: 13464 - protein, 567 aa, Theobroma cacao
MWRRSFSTGSHVSSMHMLKEKKWDALVIGGGHNGLTAAAYLARSGLSVAVLERRHIIGGAAVTEELIPGFKFSRCSYLQSLLRPSIIRELELARHGLKLLKRNPSSFTPCLDGRYLLLGPDKELNHSEISKFSKRDADAYPRYESQLERFCKLMDPLLDSPPPETLQGISSLQDRFKNKVHNSAYWTRLLCQAASLGQKDMVDFMDLLLSPASKVLNNWFETDVLKATLATDAVIGSTASVCTPGSGYVLLHHVMGETDGDRGIWSYVEGGMGSVSMAIGNAAKEAGAHIVTSAEVSQLIVEDSGKVNGVLLADGTLVHSSSVLSNATPYKTFMELVPDNVLPDDFSYAIKYSDYSSGTTKINLAVDKLPEFHCCKSIYPGSGPQHTGTIHIGSESMEEINSASQDAVNGLPSRRPVIEMTIPSVLDKTISPPGKHVINLFIQYTPYKPLDGGWDDPAYRESFAQRCFTLIDEYAPEFSSSIIGYDMLTPPDLEREIGLTGGNIFHGAMGLDSLFLMRPVKGWSNYRTPLPGLYLCGSGAHPGGGVMGAPGRNAAQLVLQDFKKKSK

SEQ ID NO: 13465 - protein, 569 aa, Prunus persica
MWRRSFSSSSSAGATSSLKDKKWDALVIGGGHNGLTAAAYLARGGLSVAVLERRHVIGGAAVTEELVPGFKFSRCSYLQSLLRPSIIKELELARHGMKLLKRSPSSFTPCLDGKYLLLGPNKDLNHSEISKFSKQDADAYPRYENQLQKFCEFMDPLLDSAPPESLQCESSCSVGDRIKNKMHNSMFWTRCLRQAATLGQKDMVDFMDLLLSPASKVLNNWFESDVLKATLATDAVIGTTRSVHTPGSGYVLLHHVMGETDGERGIWSYVEGGMGSVSLAIGNAAKEAGAHIVTCAEVQQLLINDSGTVNGVLLADGSQVHTSMVLSNATPYKTFKELVPDNVLPDDFINAIKYSDYSSGTTKINLAVDKLPQFKCCKLSHPDASPQHVGTIHIGSESMEEIHSACQDAVNGLPSQRPVIEMTIPSVLDNTISPPGKHVINLFIQYTPYSPSDGHWGDPVYRESFAQKCFTLIDEYAPGFSSSIIGYDMLTPPDLEREIGLTGGNIFHGAMGLDSLFLMRPVKGWSNYRTPLHGLYLCGSGTHPGGGVMGAPGRNAARVALEDVNKPLK

SEQ ID NO: 13466 - protein, 567 aa, Theobroma cacao
MWRRSFSTGSHVSSMHMLKEKKWDALVIGGGHNGLTAAAYLARSGLSVAVLERRHVIGGAAVTEELIPGFKFSRCSYLQSLLRPSIIRELELARHGLKLLKRNPSSFTPCLDGRYLLLGPDKELNHSEISKFSRRDADAYPRYASQLERFCKLMDPLLDSPPPETLQGISSLQDRFKNKVHNSAYWTRLLCQAASLGQKDMVDFMDLLLSPASKVLNNWFETDVLKATLATDAVIGSTASVCTPGSGYVLLHHVMGETDGDRGIWSYVEGGMGSVSMAIGNAAKEAGAHIVTSAEVSQLIVEDSGKVNGVLLADGTLVRSSSVLSNATPYKTFMELVPDNVLPDDFSYAIKYSDYSSGTTKINLAVDKLPEFHCCKSIYPGSGPQHTGTIHIGSESMEEINSASQDAVNGLPSRRPVIEMTIPSVLDKTISPPGKHVINLFIQYTPYKPLDGSWDDPAYRESFAQRCFTLIDEYAPEFSSSIIGYDMLTPPDLEREIGLTGGNIFHGAMGLDSLFLMRPVKGWSNYRTPLPGLYLCGSGAHPGGGVMGAPGRNAAQLVLQDFKKKSK

SEQ ID NO: 13467 - protein, 569 aa, Prunus mume
MWRRSFSSGSSVGATSALKDKKWDALVIGGGHNGLAAAAYLARGGLSVAVLERRHVIGGAAVTEELVPGFKFSRCSYLQSLLRPSIIKELELARHGMKLLKRSPSSFTPCLDGKYLLLGPNKDLNHSEISKFSKQDADAYPRYENQLEKFCEFMDPLLDSAPPESLQCESSCSVGDRIKNKMHNSMFWARCLRQAATLGQKDMVDFMDLLLSPASKVLNNWFESDVLKATLATDAVIGTTGSVHTPGSGYVLLHHVMGETDGEHGIWSYVEGGMGSVSLAISNAAKEAGAHIVTCAEVQQLLINDSGTVNGVLLADGSQVHTSMVLSNATPYKTFKELVPDNVLPDDFINAIKYSDYSSGTTKINLAVDRLPQFKCCKLSHPDAGPQHVGTIHIGSESMEEIHSACQDAVNGLPSQRPVIEMTIPSVLDNTISPPGKHVINLFIQYTPYSPSDGHWGDPVYRESFAQKCFNLIDEYAPGFSSSIIGYDMLTPPDLEREIGLTGGNIFHGAMGLDSLFLMRPVKGWSNYRTPLHGLYLCGSGTHPGGGVMGAPGRNAARVALEDVNKPLK

SEQ ID NO: 13468 - protein, 562 aa, Manihot esculenta
MWRRNFTTATATRALKEKKWDALVIGAGHNGLTAAAYLAKAGLSVAVLERRHVIGGAAVTEELIPGFKFSRCSYLQSLLRPSVIKELELKRHGLKLLKRNPSSFTPCLDGRYLLLGPDKNLNHSEISKFSIRDADAYPRYENQLENFSKFMDPLLDSPPPESLQGVSSLKDRFKDNIQKSAFWARCLRRALSIGQTDMVDFMNLLLSPASKVLNNWFETDVLKATLATDAVIGTTGSVHTPGSGYVLLHHVMGETDGDRGIWSYVEGGMGSVSCAIGNAAREAGAHIITSAEVSEVIINGSGEVNGVLLADDTEVLSSVVLSNATPYRTFMELVPNNVLPEDFIRAVKYSDYSSATTKINIAVDKLPQFQCCKMSHPDAGPQHMGTIHIGSENMEEIHLACEDAINGLPSRRPVIEMTIPSVLDKTISPPGKHVINLFVQYTPYSPSDGSWGDPSYRESFSKRCFNLIEEYAPGFSSSIIGYDMLTPPDLEREIGLTGGNIFHGAMGLDSLFLMRPVKGWSNYRTPLRGLYLCGSGSHPGGGVMGAPGRNAAHVVLQDVKTQ

SEQ ID NO: 13469 - protein, 562 aa, Ricinus communis
MWWRSFTTSTASRDLLGKKWDALIIGAGHNGLTAAAYLARGGLSVAVLERRHVIGGAAVTEELIPGFKFSRCSYLQSLLRPTVIKELELGRHGLKLLKRNPSSFTPCLDGRYLLLGPNKELNHSEISKFSIRDANAYPRYENQLEKFCEFMDPFLDSPPPESLQRVSSFNVRFKDKMYKSAFWARLLRGAFSLGQNEMVDFMDLLLSPASKVLNKWFETDVLKATLGTDAVIGSTGSIHTPGSGYVLLHHVMGETDGDRGIWSYVEGGMGLVSLAISNAAREAGAHIVTNAEVSEMMINDSGAVNGVLLADGRQVLSSVVLSNATPYKTFMELVPNNVLPEDFVRALKYSDYSSATTKINIAVDKLPQFRCCKLNHPDAGPQHMGTIHIGSESMEEIDLACQDAVNGLPSKRPVIEMTIPSALDKIISPPGKHVINLFIQYTPYSPSDGSWRDPAYRESFAQRCFNMIDEYAPGFNSSIIGYDMLTPPDLEREIGLTGGNIFHGAMGLDSLFLMRPVKGWSNYRTPLQGLYLCGSGSHPGGGVMGAPGRNAAHVVLQDVKNH

SEQ ID NO: 13470 - protein, 565 aa, Vitis vinifera
MWRRGFSSSAGCSNALKEKKWDALVIGAGHNGLTAGAYLARAGLSVAVLERRHIIGGAAVTEEIIPGFKFSRCSYLQSLLRPSVIKELELARHGLKLLKRNPSSFTPCVDGRYLLLGPDKDLNYSEISKFSKRDADAYLRYENQLENFCKLMDPLLDSPPPETMQGLSSFNDRIKNNVRKSVFWAHCLRSALSLGQKDLVDFMDLLLAPASKVLNNWFETDVLKATLATDAVIGSTGSVHTPGSGYVLLHHVMGETDGDRGIWSYVEGGMGSVSLAISKAAKEAGAHVVTSAEVSQLMIEDSGRVNGVLLADGTRVHSSVVLSNATPYKTFMEFVPENVLPDDFLRAIKYSDYSSGTTKMNLAVDTLPQFQCCKLSHPDAGPQHVGTIHIGSESMEEIDSASQDATNGIPSQRPIIEMTIPSVLDKTISPPGQHVINLFIQYTPYKPLDGSWEDPAYRELFAQRCFNLIDEYAPGFSSTILGYDMLTPPDLEREIGLTGGNIFHGAMGLDSLFLMRPVKGWSNYRTPLQGLYLCGSGAHPGGGVMGAPGRNAASVVLEDVKKSFN

SEQ ID NO: 13471 - protein, 212 aa, Vigna unguiculata
MASTVFTYPSLHLHIHSQKPSNPSHFSIHSQPRNHFSIRCTSPESTPLEDNFLTPDPSFSTVNSEESFPIEKRRRSEIVRERRGKKLVQPEPPNFEIGWKRTKEIKQEVPVGYVIADFLEKLETLMGKQFGSTELLAKVGEIVAERAREEAEILMDEGKVEERMVTELFRVLKLMEMDLAMVKASVKEETLGERLEQAKARCRQAILVAYSF

SEQ ID NO: 13472 - protein, 213 aa, Glycine max
MASTVFSYPSPLHLKTYPHKTSSNPSEFSIHIQPKKHFSIRCTSLDSIPEAEFPTPDPSSSTVNSAESFPIEKRRRSEIVRERRGEKLVQPEPPNFEIGWKRTKEINLERPIGHVIADFLEKLETLMEKEFGSTELLAKVGEIVAERAREEAEILMDEGKVEERMVTELFRVLKLMEMDLAMVKAAVKEETLGERLELAKARCRQAILVAYSF

SEQ ID NO: 13473 - protein, 212 aa, Glycine max
MASTVFSYPSLHLNIYPQKTSSNRSEFSIHIQPKKHFSIRCTSLDSTPEADFPTPDPSSSTVNSAESFPIEKRRRSEIVRKRRGEKLVQPEPPNFEIGWKRTKEINLERPIGHVIADFLEKLETLMGKEFGSTELLAKVGEIVAERAREEAEILMDEGKVEERMVTELFRVLKLMEMDLAMVKAAVKEETLGERLELAKARCRQAILVAYSF

SEQ ID NO: 13474 - protein, 363 aa, Medicago truncatula
MAPVPISSINVGHIDDVQELRRTKPKTVPQRFVRDMTERPTLLSPQNSDMPVIDFSKFSKGNKEEVFNELSKLSTACEEWGFFQVINHEIDLNLMENIEDMSREFFMLPLDEKQKYPMAPGTVQGYGQAFVFSEDQKLDWCNMFALGIEPHYIRNSNLWPKKPARLSETIELYSRKIRKLCQNLLKYIALGLSLEEDVFEKMFGEAVQAIRMNYYPTCSRPDLVLGLSPHSDGSALTVLQQAKGSPVGLQILKDNTWVPVEPISNALVINIGDTIEVLTNGKYKSVEHRAVAHEEKDRLSIVTFYAPSYDLELGPMLELVDENHPCKYKRYNHGEYSKHYVTNKLQGKRTLDFAKMEIMNNTN

SEQ ID NO: 13475 - protein, 745 aa, Glycine max
MVSIGSKTLVSRSSMGEHDYEPLKQGKTKRRKHKKGGSTHAFDSNSFTSPPQLSRVRKQLDPETTQYFSEISNLFESDGVELEDRSLICANALEETKGKEFEIATDYILSHTLETILQGCDVHHLCDFLHTSANHFPYIAMDRSGSHVAETSIKSLAVHLQDDDDVVRPLVEEALTMICKVIAANSVDVMCNCYGSHVLRTLLCLCRGVPLDKSGYYLSKSTTVLADRLNSKEFSSKKYDATNFQPGFPNLLKSLVSDMLKHAKKCIKILQVDQFSSLVFQTVLRVLAGDDEELLHVIPILLGCKDKNNAEDNFIGTRVVAELKNLLKESKFSHLMEVVLEVSPEALFNELFTKVFRNSLFELSSHQHGNFVVQALISYASNQDLMELIWEELGPNLEGLFKMGRSGVVASLVAASERLHINEHKCCQVLAEAVCPVDESPKWIVPRLLFLDSCFTSEDKSNWSWQSGSKMHVMGSLILQTVFRFRSECIQPYIISITSMEATHVLEAVVDARGSHVIEAFLCSGASGKQKRRLVTKLQGHFGEVALTSSGAFTIEKCFTASNLSLREAIVSEMLAVRSDLSKAKQGSYLLRKLDIDGYAANPDHWRSKQASKESTYKDFYTMFGSSDTKLTENDAFLADTSNNKSNKKTVKEMRKEIDQSLGSGAPFLSTQNFKKNPKKEKHKSKKNAQVSGDDVNSNRKKKRSNKEKVESGFDIAAKKTLKKRRRDDDLSEASLKKVKAPNAE

SEQ ID NO: 13476 - protein, 837 aa, Glycine max
MASTANHCLQLAGATESTRRWRISISCKKKSDKLAFKETKEGFVDYDRGQHEVSTKISGLRKDDIAARYRLRVAGNRFQMDWTVSEVADLVLSLNLSDDDDVDGLLNRWVGRFARKNFPFLIKELTQRGSIEHCNRVFRWLKNQKNYRARNDIYNMMIRLHARHNRTDQARGLFFEMQEWRCKPDVETYNAIINAHGRAGQWRWAMNIMDDMLRAAIPPSRSTYNNLINACGSSGNWKEALNVCKKMTENGVGPDLVTHNIILSAFKSGAQYSKALSYFELMKGTHIRPDTTTLNIVIHCLVKLRQYDKAIEIFNSMREKKSECTPDVVTFTSIIHLYSVCGQVENCEAAFNMMLAEGLKPNIVSYNALIGAYAARGMDNEAHLFFNEIKQNGFRPDIVSYTSLLNAYGRSQKPHKARQIFDRMKRNKLKPNLVSYNALIDAYGSNGLLADAIKILREMEQEGIQPNVVSICTLLAACGRCSRKVKIDTVLTAAEMRGIKLNTVAYNAAIGSCMNVGEYDKAIGLYKSMRKKKIKTDSVTYTVLISGCCKMSKYGEALSFMEEIMHLKLPLSKEVYSSAICAYSKQGQIVEAESTFNLMKSSGCYPDVVTYTAMLDAYNAAENWEKAYALFEEMEASSIKLDTIACAALMRSFNKGGQPGRVLSLAESMREKEIPFSDTIFFEMVSACSILQDWRTAVDMIKYIEPSLPVISSGCLNQFLHSLGKSGKIETMLKLFFKMLASGADVNLNTYSILLKNLLSSGNWRKYLEVLQWMEDAGIHPSKEMYHDISSFSQKCCGNENAAVIRERLESLKREFGDQISTSQPCESLVMESHSFA

SEQ ID NO: 13477 - protein, 830 aa, Cicer arietinum
MASTVSNCIQLGGGAESTRPPKSTLTRKKKTNELAFKETKDGFVDYDRGQHEVSTRITGLRKDDIPAHYRLRVAGNRFQKDWTVSEVTDSILSLTLRDDVEGLLNRWIGRFARKNFPFLIRELTQRGSIEHCNLVFSWMKNQKNYCARTDIYNMMIRLQARHNRTDQARGLFFEMQKWRCKPDAETYSALINAHGRAGQWRWAMNIMEDMLRAAIPPSRSTYNNLINACGSSGNWKEALNVCKKMTDNGVGPDLVTHNIMLSAFKSGHQYSKALSYFELMKGTHIRPDATTLNIIIHCLVKLRQYDKAIDIFNSMREKKSECHPDVVTFTSIIHLYSVSGQIENCEAAFSMMLAEGLKPNIVSYNALLGAYAARGMENEALQVFNKIKQNGLRPDIVSYTSLLNAYGRSRKPQKAREIFIMMKRNNLKPNIVSYNALIDAYGSNGLLEDAIEILREMEQDRIHPNVVSICTLLAACGRCYQKVKIDTVLSAAEMRGIKLNTVAYNSAIGSYINVGEYDKAIDLYNSMRKKNIKSDSVTYTVLISGCCKMSKYGEALSFMEEMMHLKLSMSKEVYSSVICAYSKQGQITEAESTFNLMKSCGCNPDVVTYTAMLDAYNAAEKWEKAYALFEEMEANEVKLDTIACAAVMRAFNKGGQPGMVLSLAQSMREKEIPLSDTIFFEMVSACSLLHDWKTAVDVIKYMEPSLPVISSGCLNLFLHSLGKSGKIETMLKLFFKMLASGADVNFNTYSILLKNLLSSGNWRKYLEVLQWMKDAGINPSNEMYRDISSFSQKCCGAENAAVIKERLESLKRKAGDEISASQSCESHVLS

SEQ ID NO: 13478 - protein, 830 aa, Medicago truncatula
MATTTSPYCIQLSGVTESTRPPKSTTTRKKSSNEVAFKEKKDGFVDYDRGHHQVSTKISGLRKEDIPAHYRLRVAGNRFQKDWTVSEVVDSVLSLTLRDDIEGLLNRWIGRFARKNFPFLIRELTQRGSIEHCNLVFSWMKNQKNYCARTDIYNMMIRLHARHNRTDQARGLFFEMQKCRCKPDAETYNALINAHGRAGQWRWAMNIMDDMLRAAIPPSRSTYNNLINACGSSGNWKEALNVCKKMTDNGVGPDLVTHNIMLTAFKSGTQYSKALSYFELIKGTHIRPDTTTHNIIIHCLVKLKQYDKAVDIFNSMKEKKSECHPDVVTFTSMIHLYSVCGHIENCEAAFNMMLAEGLKPNIVSYNALLGAYAARGMENEALQVFNEIKQNGFRPDVVSYTSLLNAYGRSRKPQKAREIFKMIKRNNLKPNIVSYNALIDAYGSNGLLEDAIEILREMEQDKIHPNVVSICTLLAACGRCGQKVKIDTVLSAAEMRGIKLNTVAYNSAIGSYINVGEYDKAIDLYNSMRKKKIKSDSVTYTVLISGCCKMSKFGEALSFMEEMMHLKLPMSKEVYSSIICAYSKQGQIIEAESTFNLMKSLGCSPDVVTYTAMLDAYNAAEKWEKLYALFEEMEENDVKLDTIACAALMRAFNKGGQPGRVLSLAQSMREKDIPLSDTIFFEMVSACGLLHDWKTAVDMIKYMEPSLPVISSGCLNLFLNSLGKSGKIEIMLKLFFKMLASGAEVNFNTYSILLKNLLSSGNWRKYLEVLQWMEDAGIHPSNEMYRDISFSQKNCGVENAAVIKERLESLKRNAGDQSSASQPCESHVCS

SEQ ID NO: 13479 - protein, 635 aa, Cajanus cajan
MTCCVQLCVLCIFLPYSYFIPPSRSTYNNLINACGSSGNWKEALNVCKKMTDNGVGPDLVTHNIILSAFKSGAQYSKALSYFELMKGTHIRPDTTTLNIVIHCLVKLRQYDKAIDIFNSMREKKSECTPDVVTFTSIIHLYSVCGQVESCEAAFNMILGEGLKPNIVSYNALIGAYAAHGMDNEALLVFNEIKQNGIRPDIVSYTSLLNAYGRSQKPQKARKIFDMIKKNKLKPNIVSYNALIDAYGSNGLLADAIEILREMEQDGIQPNVVSICTLLAACGRCSRKVKIDTVLTAAEMRGIKLNTVAYNSAIGSCMNVGEYDKAISLYKSMRKKKVKTDSVTYTVLISGCCKMSKYGEALSFMEEMMHLKLPLSKEVYSSVICAYSKLGQIVEAESTFNLMKSSGCYPDVVTYTAMLDAYNTAENWEKAYALFEEMEASGIKLDTVACAALMRSFNRGGQPRRVLGLAESMKEKEIPFSDTIFFEMVSACSILQDWRTAVDMINYIEPSLPVISSGCLNQFLHSLGRSGKIETMLKLFFKMLASGADVNLSTYSILLKNLLSSGNWRKYLEVLQWMEDAGIHPSTEMYHDISSFSQKCCGDENAAVIKERLGMNFHVVLRIAFPNVDMHMLSFF

SEQ ID NO: 13480 - protein, 226 aa, Unknown
  Sequence found in Organisms: Brassica napus, Brassica oleracea
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAPEEVKKSNHVQRKIESRQEGRTLDSHIEDQFASGRLLACISSRPGQCGRADGYILEGKELEFYQKKIQKKKGKGAA

SEQ ID NO: 13481 - protein, 228 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNNAAASAAKKEGEDGEDAAPAAAAAPEEVKKSNHVQRKIESRQEGRTLDSHIEDQFASGRLLACISSRPGQCGRADGYILEGKELEFYQKKIQKKKGKGAA

SEQ ID NO: 13482 - protein, 226 aa, Brassica napus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKTAPSAAKKEGEDGEEAAPAAAAAPEEVKKSNHVQRKIESRQEGRSLDSHIEDQFASGRLLACISSRPGQCGRADGYILEGKELEFYQKKIQKKKGKGAA

SEQ ID NO: 13483 - protein, 221 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAPEEVKKSNHVQRKIESRQEGRTLDSHIEDQFASGRLLACISSRPGQCGRADGYILEGKELEFYQKKIQKKK

SEQ ID NO: 13484 - protein, 225 aa, Brassica oleracea
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKTVPSAAKKEGEDGEDAAPAAAAPEEVKKSNHVQRKIESRQEGRSLDSHIEDQFASGRLLACISSRPGQCGRADGYILEGKELEFYQKKIQKKKGKGAA

SEQ ID NO: 13485 - protein, 226 aa, Brassica rapa
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKTVPSAAKKEGEDGEEAAPAAAAAPEEVKKSNHVQRKIESRQEGRSLDSHIEDQFASGRLLACISSRPGQCGRADGYILEGKELEFYQKKIQKKKGKGAA

SEQ ID NO: 13486 - protein, 225 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKSAPAAAKKEGEDGEDAAPAAAAPEEVKKSNHVLRKIESRQEGRSLDSHIEDQFASGRLLACISSRPGQCGRADGYILEGKELEFYQKKIQKKKGKGAA

SEQ ID NO: 13487 - protein, 226 aa, Raphanus sativus
MGISRDSIHKRRATGGKQKGWRKKRKYEMGRQPANTKLSSNKTVRRIRVRGGNVKWRALRLDTGNYSWGSEAVTRKTRVFDVVYNASNNELVRTKTLVKSAIVQVDAAPFKQWYLQHYGVEVGRKKKSAPAAAKKEGEDGEDAAPAAAAAPEEVKKSNHVLRKIESRQEGRSLDSHIEDQFASGRLLACISSRPGQCGRADGYILEGKELEFYQKKIQKKKGKGAA

SEQ ID NO: 13488 - protein, 227 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASAAAAAKKDGEEGEEAAPAAAAPEETKKSNHVLRKIESRQEGRSLDSHIEDQFASGRLLACISSRPGQCGRADGYILEGKELEFYQKKIQKKKGKGAA

SEQ ID NO: 13489 - protein, 228 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAASAAKKETEDGEEAAPAAAAAAAPEEVKKSNHVLRKIESRQEGRSLDSHIEEQFASGRLLACISSRPGQCGRADGYILEGKELEFYQKKIQKKKGKGAA

SEQ ID NO: 13490 - protein, 229 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAASAAKKEAEDGEEAAPAAAAAAAAPEEVKKSNHVLRKIESRQEGRSLDSHIEDQFASGRLLACISSRPGQCGRADGYILEGKELEFYQKKIQKKKGKGAA

SEQ ID NO: 13491 - protein, 226 aa, Unknown
  Sequence found in Organisms: Brassica napus, Brassica oleracea
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASAAAAKKDGEEGEEAAPAAAAPEETKKSNHVLRKIESRQEGRSLDSHIEDQFASGRLLACISSRPGQCGRADGYILEGKELEFYQKKIQKKKGKGAA

SEQ ID NO: 13492 - protein, 227 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAAPEEVKKSNHVQRKIESRQEGRTLDSHIEDQFASGRLLACISSRPGQCGRADGYILEGKELEFYQKKIRRRRARVPT

SEQ ID NO: 13493 - protein, 226 aa, Unknown
  Sequence found in Organisms: Brassica napus, Brassica juncea, Brassica rapa
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASAVAAKKDGEEGEEVAPAAAAPEETKKSNHVLRKIESRQEGRSLDSHIEDQFASGRLLACISSRPGQCGRADGYILEGKELEFYQKKIQKKKGKGAA

SEQ ID NO: 13494 - protein, 217 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAAPEEVKKSNHVQRKIESRQEGRTLDSHIEDQFASGRLLACISSRPGQCGRADGYILEGKELEFYQKK

SEQ ID NO: 13495 - protein, 225 aa, Eutrema halophilum
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASSATKKEGEDGEDASAPAAAPEETKKSNHVLRKIEQRQEGRSLDSHIEDQFASGRLLACISSRPGQCGRADGYILEGKELEFYQKKIQKKKGKGAA

SEQ ID NO: 13496 - protein, 226 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASAAAAKKDGEEGEEAAPAATAPEETKKSNHVLRKIESRQEGRSLDSHIEDQFASGRLLACISSRPGQCGRSDGYILEGKELEFYQKKIQKKKGKGAA

SEQ ID NO: 13497 - protein, 226 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASAAAVKKDGEEGGEAAPAAAAPEETKKSNHVLRKIESRQEGRSLDSHIEDQFASGRLLACISSRPGQCGRADGYILEGKELEFYQKKIQKKKGKGAA

SEQ ID NO: 13498 - protein, 226 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKSAASVAAKKDGEEGEEAAPAAAAPEETKKSNHVLRKIESRQEGRSLDSHIEDQFASGRLLACISSRPGQCGRADGYILEGKELEFYQKKIQKKKGKGAA

SEQ ID NO: 13499 - protein, 226 aa, Eutrema halophilum
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAGASTKKEGEDTEDAPAAAAATPEETKKSNHVLRKIEQRQEGRSLDSHIEDQFASGRLLACISSRPGQCGRADGYILEGKELEFYQKKIQKKKGKGAA

SEQ ID NO: 13500 - protein, 96 aa, Brassica napus
MGISRDSIHKRRATGGKQKGWRKKRKYEMGRQPANTKLSSNKTVRRIRVRGGNVKWRALRLDTGNYSWGMKLLLARPEFLMWSTMPPTTSWSVPRH

SEQ ID NO: 13501 - protein, 104 aa, Brassica napus
MGISRDSIHKRRATGGKQKQWRKKRKYEMGRQPANTKLSSNKTVRRIRVRGGNVKWRALRLDTGNYSWGMKLLPARPGFLMLSTTLPTRARQDQDSCQECYCSG

SEQ ID NO: 13502 - protein, 226 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKSAVAAASKKDGEDGEEAAPAAAAPEETKKSNHVLRKIESRQEGRSLDSHIEDQFASGRLLACISSRPGQCGRADGYILESKELEFYQKKIQKKKGKGAA

SEQ ID NO: 13503 - protein, 226 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKSAASVAAKKDGEEGEEAAPAAAAPEETKKSNHVLRKIESRQEGRSLDSHIEDQFASGRLLACISFRPGQCGRADGYILEGKELEFYQKKIQKKKGKGAA

SEQ ID NO: 13504 - protein, 226 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNAPNNELARTKTLVKSAIVQVDAAPFKQWYLQHYGVEVGRKKKSAVAAAKKDGEEGDEAAPAAAAAPEETKKSNHVLRKIESRQEGRSLDCHIEDQFASGRLLACISFRPGQCGRADGYILEGKELEFYQKKIQKKKGKGAA

SEQ ID NO: 13505 - protein, 230 aa, Eutrema halophilum
NIILLLGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNASSATKKEGEDGEDASAPAAAPEETKKSNHVLRKIEQRQEGRSLDSHIEDQFASGRLLACISSRPGQCGRADGYILEGKELEFYQKKIQKKKGKGAA

SEQ ID NO: 13506 - protein, 222 aa, Arabidopsis thaliana [sequence omitted]

SEQ ID NO: 13507 - protein, 220 aa, Arabidopsis lyrata
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLSHYGVEVGRKKKNAASTKKDAEEGEEVAAVEETKKSNHLSRKIESRQEGRSLDSHIEDQFASGRLLACISSRPGQCGRADGYILEGKELEFYMKKIQKKKGKGAA

SEQ ID NO: 13508 - protein, 222 aa, Cleome gynandra
MGISRDSIHKRRATGGKQKQWKEKRKYEMGRVAANTKLSSNKTVRRVRVRGGNVKWRALRLDTGNYSWGSEAVTRKTRILDVVYNASNNELVRTKTLVKSAIVQVDAAPFKQWYLQHYGVEVGRKKKSAATSAKKEGEEGEDSTAAPEETKKSNHVLRKLEKRQQDRTLDQHIEDQFASGRLLACISSRPGQCGRADGYILEGKELEFYMKKIQKKKGKGTA

SEQ ID NO: 13509 - protein, 222 aa, Cleome spinosa
MGISRDSIHKRRATGGKQKQWRKKRKYELGRVAANTKLSSNKTVRRVRVRGGNVKWRALRLDTGNYSWGSEAVTRKTRILDVVYNASNNELVRTKTLVKSAIVQVDAAPFKQWYLQHYGVEIGRKKKTPATSGKKEGEEGEDGAAAPEETKKSNHVLRKLEKRQKNRALDSHIEDQFASGRLLACISSRPGQCGRADGYILEGKELEFYMKKIQKKKGKGAA

SEQ ID NO: 13510 - protein, 220 aa, Cleome spinosa
MGISRDSIHKRRATGGKQKQWRKKRKYELGRVAANTKLSSNKTVRRVRVRGGNVKWRALRLDTGNYSWGSEAVTRKTRILDVVYNASNNELVRTKTLVKSAIVQVDVAPFKQWYLQHYGVEVGRKKKTAAASGKKEGEEGEDAAPEETKKSNHVLRKLEKRQQNRSLDSHIEDQFASGRLLACISSRPGQCGRADGYILEGKELEFYMKKIQKKKGKGTA

SEQ ID NO: 13511 - protein, 221 aa, Cleome spinosa
MGISRDSIHKRRATGGKQKQWRKKRKYELGRVAANTKLSSNKTVRRVRVRGGNVKWRALRLDTGNYSWGSEAVTRKTRILDVVYNSSNNELVRTKTLVKSAIVQVDAAPFKQWYLQHYGVEVGRKKKTAATAGKKEGEEGEDTAALEETKKSNHVLRKLEKRQQNRNLDPHIEDQFASGRLLACISSRPGQCGRADGYILEGKELEFYMKKIQKKKGKGTA

SEQ ID NO: 13512 - protein, 209 aa, Raphanus sativus
MGISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAASAAKKEAEDGEEAAPAAAAAAAPEEVKKSNHVLRKIESRQEGRSLDSHIEDQFASGRLLACISSRPGQCGRADGYISGR

SEQ ID NO: 13513 - protein, 218 aa, Gossypium hirsutum
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAAAKKEGEEGETATEEVKKSNHVLRKLEKRQQSRTLDSHIEEQFGSGRLLACISSRPGQCGRADGYILEGKELEFYMKKIQRKKGKGAA

SEQ ID NO: 13514 - protein, 219 aa, Glycine max
MGISRDSMHKRRATGGKKKSWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVEVGRKKKSAAASVKKEGEDGEAATEEVKKSNHVVRKLEKRKQNRVLDPHIEEQFGGGRLLACISSRPGQCGRADGYILEGKELEFYMKKLQKKKGKGAA

SEQ ID NO: 13515 - protein, 219 aa, Glycine max
MGISRDSMHKRRATGGKKKAWRKKRKYELGRQPANTKLSSNKTVRRIRVRGGNVKWRALRLDTGNYSWGSEAATRKTRILDVVYNASNNELVRTQTLVKSAIVQVDAAPFKQWYLQHYGVEVGRKKKSAAASAKKEGEDGEAATEEVKKSNHVLRKLEKRKQNRVLDPHIEEQFGGGRLLACISSRPGQCGRADGYILEGKELEFYMKKLQKKKGKGAA

SEQ ID NO: 13516 - protein, 225 aa, Prunus mume
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFKQWYLQHYGVEIGRKKKTAAAAKKEGEEGDAAAAPAAVAEEVKKSNHVVRKLEKRQQSRTLDQHIEEQFGGGRLLACISSRPGQCGRADGYILEGKELEFYMKKLQRKKGKGAAA

SEQ ID NO: 13517 - protein, 219 aa, Glycine max
MGISRDSMHYRRATGGKKKAWRKKRKYELGRQPANTKLSSNKTVRRIRVRGGNVKWRALRLDTGNYSWGSEAATRKTRILDVVYNASNNELVRTQTLVKSAIVQVDAAPFKQWYLQHYGVEVGRKKKSAAASAKKEGEDGEAATEEVKKSNHVLRKLEKRKQNRVLDPHIEEQFGGGRLLACISSRPGQCGRADGYILEGKELEFYMKKLQKKKGKGAA

SEQ ID NO: 13518 - protein, 220 aa, Glycine max
MGISRDSMHKRRATGGKKKAWRKKRKYELGRQPANTKLSSNKTVRRIRVRGGNVKWRALRLDTGNYSWGSEAVTRKTRVLDVVYNASNNELVRTQTLVKSAIVQVDAAPFKQWYLQHYGVEIGRKKKTAAKKETAEEGGDAAAAAEEAKKSNHVQRKLEKRQKDRKLDAHIEEQFGGGRLLACISSRPGQCGRADGYILEGKELEFYMKKLQKKKGKGAA

SEQ ID NO: 13519 - protein, 224 aa, Quercus alba
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTTASTKKEGEEGEAAAATATTEEVKKSNHVQRKLEKRQQNRKLDSHIEEQFGGGRLLACISSRPGQCGRADGYILEGKELEFYMKKIQRKKGKAGAA

SEQ ID NO: 13520 - protein, 225 aa, Prunus persica
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFKQWYLQHYGVEIGRKKKTAAAAKKEGEEGDAAAAPAAVAEEVKKSNHVVRKLEKRQQSRTLDQHIEEQFGGGRLLACISSRPGQCGRSDGYILEGKELEFYMKKLQRKKGKGAAA

SEQ ID NO: 13521 - protein, 225 aa, Juglans hindsii x Juglans regia
MGISRDSMHKRRATGGKKKAWRKKRKYELGRQPANTKLSSNKTVRRIRVRGGNVKWRALRLDTGNYSWGSEAVTRKTRLLDVVYNASNNELVRTQTLVKSAIVQVDAAPFKQWYLQHYGVDIGRKKKTLASTKKESEEGDAPAAAAAPATEEAKKSNHVQRKLEKRQQNRKLDAHIEEQFGSGRLLACISSRPGQCGRADGYILEGKELEFYMKKIQRKKGKGAA

SEQ ID NO: 13522 - protein, 224 aa, Cleome spinosa
MGISRDSIHKRRATGGKQKQWRKKRKYELGRVAANTKLSSNKTVRRLRVRGGNIKWRALRLDTGNFSWGSEAATRKSRILDVVYNASNNELVRTKTLVKSAIVQIDAAPFKQWYLSHYGVEVGRKKKASASSGKKEEEGEDGAEKAAAPEETKKSNHVLRKLEKRQQNRALDSHIDDQFSTGRLLACISSRPGQCGRADGYILEGKELEFYMKKIQKKKGKGAA

SEQ ID NO: 13523 - protein, 219 aa, Cajanus cajan
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKSAAASAKKEGEDGEAATEEVKKSNHVLRKLEKRKQNRVLDPHIEEQFGGGRLLACISSRPGQCGRADGYILEGKELEFYMKKLQRKKGKGAA

SEQ ID NO: 13524 - protein, 226 aa, Brachypodium distachyon
MGISRDSMHKRRATGGKQKAWRKKRKYELGRQPANTKLSSNKTVRRVRVRGGNVKWRALRLDTGNYSWGSEAVTRKTRLLDVVYNSSNNELVRTQTLVKNAIVQVDAAPFKQWYLTHYGVDIGRKKKTPAATKKDATEDGDAAAPAAAAAEEAKKSNNVQRKLEKRQQGRTLDPHIEEQFSSGRLLACISSRPGQCGRADGYILEGKELEFYMKKLQKKKGKGAAA

SEQ ID NO: 13525 - protein, 226 aa, Brachypodium distachyon
MGISRDSMHKRRATGGKQKAWRKKRKYELGRQPANTKLSSNKTVRRVRVRGGNVKWRALRLDTGNYSWGSEAVTRKTRLLDVVYNSSNNELVRTQTLVKNAIVQVDAAPFKQWYLTHYGVDIGRKKKTPAATKKDATEDGDAAAPAAAAAEETKKSNNVQRKLEKRQQGRTLDPHIEEQFSSGRLLACISSRPGQCGRADGYILEGKELEFYMKKLQKKKGKGAAA

SEQ ID NO: 13526 - protein, 219 aa, Fagopyrum esculentum
MGISRDSMHKRRATGGKKKSWRKKRKYELGRQPANTKLSSNKTVRRVRVRGGNVKWRALRLDTGNYSWGSEAVTRKTRVLDVVYNASNNELVRTQTLVKSAIVQVDAAPFKQWYLQHYGVDIGRKKKTAASAKKEGEEGEATEEGKKSNHVQRKLEKRQEGRTLDAHIEEQFSSGRLLAAISSRPGQCGRADGYILEGKELEFYMKKLQKKKGKSAGAA

SEQ ID NO: 13527 - protein, 216 aa, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEGEEGETGTEEVKKSNHVLRKLEKRQQNRKLDPHIEDQFASGRLLACISSRPGQCGRADGYILEGKELEFYMKKIQRKKGKGAA

SEQ ID NO: 13528 - protein, 222 aa, Malus domestica
MGISRDSMHKRRATGGKKKAWRKKRKYELGRQPANTKLSSNKTVRRIRVRGGNVKWRALRLDTGNFSWGSETVTRKTRLLDVVYNASNNELVRTQTLVKSAIVQVDAAPFKQWYLQHYGVEIGRKKKTAAAAKKEAEDGEAPAAAPEEAKKSNHVARKLEKRQQTRTLDQHIEEQFGGGRLLACISSRPGQCGRCDGYILEGRELEFYMKKLQRKKGKGAAA

SEQ ID NO: 13529 - protein, 217 aa, Unknown
  Sequence found in Organisms: Gossypium hirsutum, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGIDIGRKKKSAAAKKEGEEGETATEEVKKSNHVLRKLEKRQQNRTLDPHIEEQFGSGRLLACISSRPGQCGRADGYILEGKELEFYMKKIQRKKGKGAA

SEQ ID NO: 13530 - protein, 219 aa, Cajanus cajan
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKSAAASAKKEGEDAEAATEEVKKSNHVLRKLEKRKQNRVLDPHIEEQFGGGRLLACISSRPGQCGRADGYILEGKELEFYMKKLQRKKGKGAA

SEQ ID NO: 13531 - protein, 219 aa, Populus trichocarpa
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGVDIGRKKKTTAAAKKEGEEGEAAATEEVKQSNHVQRKLEKRQQIRKLDPHIEEQFGSGRLLASISSRPGQCGRADGYILEGKELEFYMKKIQRKKGKGAA

SEQ ID NO: 13532 - protein, 217 aa, Silene vulgaris
MGISRDSMHKRRETGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVEVGRKKKSAAAPKKEGEDGETAEETKKSNHVTRKLEKRQEGRELDAHIEEQFGGGRLLACISSRPGQCGRCDGYILEGKELEFYMKKIQKKKGKSAA

SEQ ID NO: 13533 - protein, 153 aa, Ambrosia trifida
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKAAASAAKKRERKEKVQPKRPKRVIML

SEQ ID NO: 13534 - protein, 152 aa, Fagus grandifolia
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQCISSTMELILVARRRLQLPPRKKGRKVMLLLLLLLLPLRT

SEQ ID NO: 13535 - protein, 70 aa, Castanea mollissima
MGISRDSMHKRRATGGKKKAWRKKRKYELGRQPANTKLSSNKTVRRIRVRGGNVKWRALRLDTGNFSVGE

SEQ ID NO: 13536 - protein, 137 aa, Gossypium hirsutum
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWVSPALWCRHWSQEENSSQERRRGR

SEQ ID NO: 13537 - protein, 224 aa, Valeriana officinalis
MGISRDSMHKRRATGGKKKAWRKKRKYELGRQPANTKLSSNKTVRRVRVRGGNVKWRALRLDTGNFSWGSEAVTRKTRLLDVVYNASNNELVRTQTLVKSAIVQVDAAPFKQWYLTHYGVEIGRKKKSAAPAKKETAEEGEAAAAAAAEEAKKSNHVARKIEKRQAERKLDSHIEEQFGGGRLLACISSRPGQCGRADGYILEGKELEFYMKKLQKKKGKGAAA

SEQ ID NO: 13538 - protein, 220 aa, Ambrosia trifida
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAASAAKKEGEEGEGATEEAKKSNHVVRKLEKRQEDRKLDSHVEEQFSSGRLLAAISSRPGQCGRADGYILEGKELEFYMKKLQKKKGKGAAA

SEQ ID NO: 13539 - protein, 221 aa, Amsonia hubrichtii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAAAKKEGEEDEGAAAAEDTKKSNHVQRKLEKRQKDRKLDPHIEEQFGSGRLMACISSRPGQCGRADGYILEGKELEFYMKKIQRKKGKSGAA

SEQ ID NO: 13540 - protein, 221 aa, Cynodon dactylon
MGISRDSMHKRRATGGKQKAWRKKRKYELGPQPANTKLSSNKTVRRVRVRGGNVKWRALRLDTGNYSWGSEAVTRKTRILDVVYNASNNELVRTQTLVKSAIVQVDAAPFKQWYLTHYGVEIGRKKKAPAAKKDVAEGQEAEAAAEETKKSNHVQRKLEKRQEGRTLDPHIEEQFGSGRLLACISSRPGQCGRADGYILEGKELEFYMKKLQKKKGKGAAA

SEQ ID NO: 13541 - protein, 221 aa, Cynodon dactylon
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTPAAKKEGAEGQEGEAAAEETKKSNHVQRKLEKRQEGRTLDPHIEEQFGSGRLLACISSRPGQCGRADGYILEGKELEFYMKKLQKKKGKGAAA

SEQ ID NO: 13542 - protein, 225 aa, Fragaria vesca
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYSTHYGVEIGRKKKTAAAIKKEAEDGEAATAAAAAAEEVKKSKHVERKLEKRQQTRVLDHHIEEQFGGGRLLACISSRPGQCGRADGYILEGKELEFYMKKLQRKKGKGATA

SEQ ID NO: 13543 - protein, 217 aa, Unknown
  Sequence found in Organisms: Gossypium hirsutum, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGIDIGRKKKSAAAKKEGEEGETATEEVKKSNHVLRKLEKRQQNRALDPHIEEQFGSGRLLACISSRPGQCGRADGYILEGKELEFYMKKIQRKKGKGAA

SEQ ID NO: 13544 - protein, 217 aa, Antirrhinum majus
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYSQHYGVEIGRKKKTAAKKEGEEAEAAPAEEVKKSNHVQRKIEKRQEGRKIDAHIEEQFGGGRLLASISSRPGQCGRADGYILEGKELEFYMKKLQRKKGKGAA

SEQ ID NO: 13545 - protein, 220 aa, Theobroma cacao
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAAAAKKEGGEDGEIATEEVKKSGHVLRKLEKRQLNRKLDSHIEEQFGSGRLLACISSRPGQCGRADGYILEGKELEFYMKKIQRKKGKGAA

SEQ ID NO: 13546 - protein, 216 aa, Gossypium hirsutum
MGISRDSMHKRRATGGKKKAWRKKRKYELGRQPANTKLSSNKTVRRIRVRGGNVKWRALRLDTGNYSWGSEAMTRKTRILDVVYNASNNELVRTQTLVKSAIVQVDAAPFKQWYLQHYGVDIGRKKKTAAKKEGEEGETGTEEVKKSNHVLRKMEKRQQNRKLDPHIEDQFASGRLLACISSRPGQCGRADGYILEGKELEFYMKKIQRKKGKGAA

SEQ ID NO: 13547 - protein, 218 aa, Silene vulgaris
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVEIGRKKKAAAAAAKKEGEDGEATEETKKSNHVTRKLEKRQQDRELDAHIEEQFGGGRLLACISSRPGQCGRCDGYILEGKELEFYMKKIQRKKGKSAA

SEQ ID NO: 13548 - protein, 223 aa, Citrus clementina
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAAATTKKEGEEGEAPATEEAKKSNHVSRKLEKRQKDRTLDPHIEEQFGSGRLLACIASRPGQCGRADGYILEGKELEFYMKKLQRKKGKSAGAA

SEQ ID NO: 13549 - protein, 219 aa, Fagopyrum esculentum
MGISRDSMHKRRATGGKKKSWRKKRKYELGRQPANTKLSSNKTVRRVRVRGGNVKWRALRLDTGNYSWGSEAVTRKTRVLDVVYNASNNELVRTQTLVKSAIVQVDAAPFKQWYLQHYGVDIGRKKKTATSAKKEGEEGEATEEAKKSKHVQRKLEKRQEGRTLDAHIEEQFSSGRLLAAISSRPGQCGRADGYILEGKELEFYMKKLQKKKGKSAGAA

SEQ ID NO: 13550 - protein, 219 aa, Fagopyrum esculentum
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKTATSAKKEGEDGEATEEAKKSNHVQRKLEKRQEGRSLDAHIEEQFSSGRLLAAISSRPGQCGRADGYILEGKELEFYMKKLQKKKGKSAGAA

SEQ ID NO: 13551 - protein, 219 aa, Eragrostis curvula
MGISRDSMHKRRATGGKQKAWRKKRKYELGRQPANTKLSSNKTVRRVRVRGGNVKWRALRLDTGNYSWGSEAVTRKTRLLDVVYNASNNELVRTQTLVKSVIVQVDAAPFKQWYLTHYGVDIGRKKKAPAAKKEGAEEGEAAAEETKKSNHVQRKLEKRQQGRTLDPHIEEQFGSGRLLACISSRPGQCGRADGYILEGKELEFYMKKLQRKKGKGAAA

SEQ ID NO: 13552 - protein, 218 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAKKEGEEGEAATEEAKKSNHVQRKIEKRQEDRKIDAHIEEQFGGGRLLAAISSRPGQCGRADGYILEGKELEFYMKKLQRKKGKGAA

SEQ ID NO: 13553 - protein, 218 aa, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAGAKKEGEEGETATEEVKKSSHVLRKLEKRQQSRTLDPHIEEQFGSGRLLACISSRPGQCGRADGYILEGKELEFYMKKMQRKRGKGAA

SEQ ID NO: 13554 - protein, 219 aa, Unknown
  Sequence found in Organisms: Gossypium hirsutum, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDLGRKKKTLAAATKKDGEEGETVAEEAKKSNHVLRKLEKRQQNRKLDPHIEDQFSSGRLLACISSRPGQCGRADGYILEGKELEFYMKKIQRRKGKGAA

SEQ ID NO: 13555 - protein, 217 aa, Arachis hypogaea
MGISRDSMHKRRATGGKKKVWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAAKKDAEEGETPTEEAKKSNHVQRKIEKRQKDRKLDPHIEEQFGGGRLLACIASRPGQCGRADGYILEGKELEFYMKKIQKKKGKGAA

SEQ ID NO: 13556 - protein, 218 aa, Arachis hypogaea
MGISRDSMHKRRATGGKKKVWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAAKKDAAEEGETPAEEAKKSNHVQRKIEKRQKDRKLDPHIEEQFGGGRLLACIASRPGQCGRADGYILEGKELEFYMKKIQKKKGKGAA

SEQ ID NO: 13557 - protein, 219 aa, Glycine max
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVEIGRKKKTAAKKETAEEGAAAVAVEEAKKSNHLQRKLEKRQKDRKLDAHIEEQFGGGRLLACISSRPGQCGRADGYILEGKELEFYMKKLQKKKGKGAA

SEQ ID NO: 13558 - protein, 218 aa, Phaseolus vulgaris
MGISRDSMHKRRATGGKKKAWRKKRKYELGRQPANTKLSSNKTIRRIRVRGGNVKWRALRLDTGNYSWGSEAVTRKTRILDVVYNASNNELVRTQTLVKSAIVQVDAAPFKQWYLQHYGVDIGRKKKIVASAKKEGEDGEAATEEVKKSNHVLRKLEKRKQSRVLDSHIEEQFGGGRLLACISSRPGQCGRSDGYILEGKELEFYMKKLQKKKGKGAA

SEQ ID NO: 13559 - protein, 218 aa, Cyamopsis tetragonoloba
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYDVDVGRKKKSATSAKKEGEDAEAATEEVKKSNHVLRKLEKRKQNRVLDPHIEEQFGGGRLLACISSRPGQCGRADGYILEGKELEFYMKKLQKKKGKGAA

SEQ ID NO: 13560 - protein, 219 aa, Eucalyptus grandis
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKNQASAKKEGEEAEAPAEEVKKSSHVLRKLEKRQTERKLDQHIEEQFSSGRLLASISSRPGQCGRADGYILEGKELEFYMKKIQRKKGKGAAA

SEQ ID NO: 13561 - protein, 222 aa, Euphorbia peplus
MGISRDSLHKRRATGGKKKVWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDIGRKKKTTLAKKDGEEGEAAAAAATEEVKKSNHVTRKLETRQQTRKLDSHIEEQFSGGRLLACISSRPGQCGRCDGYILEGKELEFYMKKLQKKKGKGAAA

SEQ ID NO: 13562 - protein, 217 aa, Fagopyrum esculentum
MGISRDSLHKRRATGGKKKVWRKKRKYELGRQPANTKLSSNKTVRRVRVRGGNVKWRALRLDTGNYSWGSEAVTRKTRVLDVVYNASNNELVRTQTLVKSAIVQVDAAPFKQWYLQHYGVEIGRKKKSAASTKKEGDEAEATEEEKKSNHVKRKLEKRQEGRTLDAHIEEQFSSGRLLAAISSRPGQCGRADGYILEGKELEFYMKKLQKKKGKAAA

SEQ ID NO: 13563 - protein, 217 aa, Mesembryanthemum crystallinum
MGISRDSMHKRRATGGKKKAWRKKRKYELGRQPAMTKLSSNKTVRRVRVRGGNVKWRALRLDTGNFSWGSEAVTRKTRLLDVVYNASNNELVRTQTLVKSAIVQVDAAPFKQWYLQHYGVEVGRKKKGAAAAAKKEGEEETTEEAKKSNHVARKIEKRQQGRTLDPHIEEQFGGGRLLACISSRPGQCGRADGYILEGKELEFYMKKLQRKKGKSAA

SEQ ID NO: 13564 - protein, 217 aa, Trigonella foenum-graecum
MGISRDSMHKRRATGGKQKTWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEVGRKKKTAAKKDSAEEAEVVAEEVKKSNHVQRKLEQRQKDRQLDSHIEEQFGGGRLLACISSRPGQCGRADGYILEGKELEFYMKKLQKKKGKTAA

SEQ ID NO: 13565 - protein, 197 aa, Triticum aestivum
GISRDSIHKRRATGGKQKGWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKTAPSAAKKEGEDGEEAAPAAAAAPEEVKKSNHVQRKIESRQEGRSLDSHIEDQFASGRLLACISSRPGQCG

SEQ ID NO: 13566 - protein, 274 aa, Ambrosia trifida
MVQYNFKKITKVPTGKDFVDIVLSRTQRQTPTVVHKGYAINRIRQFYMRKVKFTQTNFHEKLSTIIEEFPRLDDIHPFYGDLLHVLYNKDHYKLALGQINTARNLISKIAKDYVKLLKYGDSLYRCKALKVAALGRMCTVTKRIGPSLAYLDQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYTIAQQAALFTV

SEQ ID NO: 13567 - protein, 192 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAKKEGEEGEAATEEAKKSNHVQRKIEKRQEDRKIDAHIEEQFGGGRLLAAISSRPGPMRSC

SEQ ID NO: 13568 - protein, 229 aa, Brachypodium distachyon
MGISRDSMHKRRATGGKQKAWRKKRKYELGRQPANTKLSSNKTVRRVRVRGGNVKWRALRLDTGNYSWGSEAVTRKTRLLDVVYNSSNNELVRTQTLVKNAIVQVDAAPFKQWYLTHYGVDIGRKKKTPAATKKDATETLQDGDAAAPAAAAAEETKKSNNVQRKLEKRQQGRTLDPHIEEQFSSGRLLACISSRPGQCGRADGYILEGKELEFYMKKLQKKKGKGAAA

SEQ ID NO: 13569 - protein, 219 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAKKEGEEGEAATEEAKKSNHVQRKIEKRQEDRKIDAHIEEQFGGGRLLAAISSRPGQCGRADGYILEGKELEFYMKKLQRKKGKGAAA

SEQ ID NO: 13570 - protein, 221 aa, Cajanus cajan
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVEIGRKKKTAAKKDFAEEGDATAVAAAEESKKSNHVQRKLEKRQKDRKLDPHIEEQFGGGRLLACISSRPGQCGRSDGYILEGKELEFYMKKLQRKKGKGAA

SEQ ID NO: 13571 - protein, 225 aa, Triticum aestivum
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 13572 - protein, 87 aa, Panax ginseng
CHLGCRRRIHRLQTWVFLGIRCTKGVPLEARRRLGGRSESMNSEDNLQTQSCLATRQLRRVRVRGGNVKWRALKVGHRELLLGVVRL

SEQ ID NO: 13573 - protein, 69 aa, Panax ginseng
MGISRDSMHKRRATGGKKKAWRKKRKYELGRQPANTKLSSNKTVRRVRVRGGNVKWRALRLDTGELLLG

SEQ ID NO: 13574 - protein, 61 aa, Gossypium raimondii
MGISRDSMHKRRATGGKKKAWRKKRKYELGRQPANTKLSSNKTVRRIRVRGGNVNVACLEA

SEQ ID NO: 13575 - protein, 218 aa, Arachis hypogaea
MGISRDSMHKRRATGGKKKVWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKGATSGKKEGEDAETATEEVKKSNHVLRKLEKRKQTRVLDSHIEEQFGSGRLLASISSRPGQCGRADGYILEGKELEFYMKKLQKKKGKGAA

SEQ ID NO: 13576 - protein, 218 aa, Ambrosia trifida
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKVAAAAKKEGEEAEAATEEAKKSNHVVRKLEKRQEERKLDAHVEEQFSSGRLLAAISSRPGQCGRADGYILEGKELEFYMKKLQKKKGKGAA

SEQ ID NO: 13577 - protein, 228 aa, Cannabis sativa
MGISRDSMHKRRATGGKKKAWRKKRKYELGRQPANTKLSSNKTVRRIRVRGGNVKWRALRLDTGNFSWGSEAVTRKTRLLDVVYNSSNNELVRTQTLVKGAIIQVDAAPFKQWYLQHYGVDIGRKKKTPAAAAAAKKDTPEEGEAAAPAAEEAKKSNHVQRKIEKRQEARTLDAHIEEQFSSGRLYACISSRPGQCGRADGYILEGKELEFYVKKLQRKKGKAAGAAA

SEQ ID NO: 13578 - protein, 219 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAATATKKEGEEVEAATEETKKSNHVVRKLEKRQEERKLDPHVEEQFSSGRLLAAISSRPGQCGRADGYILEGKELEFYMKKLQKKKGKGAA

SEQ ID NO: 13579 - protein, 217 aa, Helianthus annuus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKAAAAKKEGEEAEAATEEAKKSNHVVRKLEKRQEERKLDPHVEEQFSSGRLLAAISSRPGQCGRADGYILEGKELEFYMKKLQKKKGKGAA

SEQ ID NO: 13580 - protein, 224 aa, Amorphophallus konjac
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKQQPAAAAAKKEGEEGEGPAEETKKSNHVTRKIEKRQQGRKLDSHIEEQFGGGRLLAAISSRPGQCGRADGYILEGKELEFYLKKIQRKKGKGAGASA

SEQ ID NO: 13581 - protein, 224 aa, Humulus lupulus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIIQVDAAPFKQWYLQHYGVDIGRKKKTAAAAKKETPEEGEAAPPAEETKKSNHVQRKIEKRQQARTLDSHIEEQFSSGRLYAAISSRPGQCGRADGYILEGKELEFYVKKLQRKKGKAAGAAA

SEQ ID NO: 13582 - protein, 219 aa, Gossypium raimondii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEATEDGEVAAEETKKSNHVLRKLEKRQKERTLDAHIEEQFGSGRLLACISSRPGQCGRADGYILEGKELEFYMKKIQRKKGKGAGAA

SEQ ID NO: 13583 - protein, 225 aa, Euphorbia esula
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGLDIGRKKKAVAAKKETTEEGDGAAPAAQVEETKKSNHVARKIEKRQKDRKLDSHIEEQFGGGRLLACISSRPGQCGRADGYILEGKELEFYMKKLQKKKGKGASAA

SEQ ID NO: 13584 - protein, 140 aa, Panicum virgatum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAGGSRG

SEQ ID NO: 13585 - protein, 219 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAKKEGEEGEAATEEAKKSNHVQRKIEKRQEDRKIDAHIEEQFGGGRLLAAISSRPGQCGRSDGYILEGKELEFYMKKLQRKKGKGAAA

SEQ ID NO: 13586 - protein, 218 aa, Lupinus angustifolius
MGISRDSMHKRRATGGKKKAWRKKRKYELGRQPANTKLSSNKTVRRIRVRGGNVKWRALRLDTGNFSWGSEAVARKTRLLDVVYNASNNELVRTQTLVKGAIVQVDAAPFKQWYLQHYGVEVGRKKKTASKKDTAEEGEAAAAEETKKSNHVQRKIEKRQTDRNLDSHIEEQFGGGRLLAAISSRPGQCGRADGYILEGKELEFYLKKLQKKKGKGAA

SEQ ID NO: 13587 - protein, 220 aa, Oryza sativa
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAEGQDAEATTEEAKKSNHVVRKLEKRQQGRTLDAHIEEQFGSGRLLACISSRPGQCGRADGYILEGKELEFYMKKLQRKKGKGASA

SEQ ID NO: 13588 - protein, 221 aa, Sorghum bicolor
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKEAAEGQEGEAAAEEAKKSNHVKRKLEKRQEGRELDAHIEEQFGSGRLLACISSRPGQCGRADGYILEGKELEFYMKKLQRKKGKGAAA

SEQ ID NO: 13589 - protein, 219 aa, Manihot esculenta
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIIQVDAAPFKQWYLQHYGVDIGRKKKTAAAKKEGEEGEAATEEVKKSNHVLRKLEKRQQTRKLDPHIEEQFGSGRLLACISSRPGQCGRADGYILEGKELEFYMKKLQRKKGKGAGAA

SEQ ID NO: 13590 - protein, 221 aa, Coffea canephora
MGISRDSMHKRRATGGKKKAWRKKRKYELGRQAANTKLSSDKTVRRIRVRGGNVKWRALRLDTGNYSWGSEAVTRKTRILDVVYNASNNELVRTQTLVKSAIVQVDAAPFKQWYLQHYGVDIGRKKKAVVVKKEGEEGEAAAATEETKKSNHVLRKIEKRQKERKLDAHIEEQFGSGRLLACISSRPGQCGRADGYILEGKELEFYMKKIQRKKSKSTGAA

SEQ ID NO: 13591 - protein, 218 aa, Fagopyrum esculentum
MGISRDSMHKRRATGGKKKAWRKKRKYELGRQPANTKLSSNKTVRRVRVRGGNVKWRALRLDTGNYSWGSEAVTRKTRVLDVVYNASNNELVRTQTLVKSAIVQVDAAPFKQWYLQHYGVDIGRKKKTVSAKKEGEEGEAAEEAKKSNHVQRKLEKRQQGRTLDQHIEEQFSGGRLLAAISSRPGQCGRADGYILEGKELEFYMKKLQKKKGKAAGAA

SEQ ID NO: 13592 - protein, 220 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKTAASAGKKEGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13593 - protein, 225 aa, Unknown
  Sequence found in Organisms: Leymus cinereus x Leymus triticoides, Pseudoroegneria spicata
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 13594 - protein, 220 aa, Allium cepa
MGISRDSMHKRRATGGKKKAWRKKRKYEMGRQPANTKLSSNKTVRRIRVRGGNVKWRALRLDTGNYSWGSEAVTRKTRILDVVYNASNNELVRTQTLVKSAIVQVDAAPFKQWYLTHYGVDIGRKKKAPTTGKKEAAEESEPAAAEVKKSSHVLRKLEKRQKERTLDSHIEEQFGSGRLLACISSRPGQCGRADGYILEGKELEFYMKKLQKKKGKAAAA

SEQ ID NO: 13595 - protein, 223 aa, Juglans hindsii x Juglans regia
  misc_feature (48)..(48): Xaa can be any naturally occurring amino acid
  misc_feature (171)..(171): Xaa can be any naturally occurring amino acid
MGISRDSMHKRRATGGKKKAWRKKRKYELGRQPANTKLSSNKTVRRIXVRGGNVKWRALRLDTGNYSWGSEAVTRKTRLLDVVYNASNNELVRTQTLVKSAIVQVDAAPFKQWYLQHYGVDIGRKKKTSASTKKEGEEGDAAAAVAEEVKKSNHVQRKLEKRQQNRKLDLXIEEQFGSGRLLACISSRPGQCGRADGYILEGKELEFYMKKIQRKKGKGAGAA

SEQ ID NO: 13596 - protein, 217 aa, Medicago truncatula
MGISRDSMHKRRATGGKKKSWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEVGRKKKTAAKKDSAEEAEVVAEEVKKSSHVQRKLEQRQKDRQLDSHIEEQFGGGRLLACISSRPGQCGRADGYILEGKELEFYMKKLQKKKGKSAA

SEQ ID NO: 13597 - protein, 216 aa, Chenopodium quinoa
MGISRDSMHKRRATGGKKKAWRKKRKYELGRQPANTKLSSNKTVRRVRVRGGNVKWRALRLDTGNFSWGSEAVTRKTRLLDVVYNASNNELVRTQTLVKSAIVQVDAAPFKQWYLQHYGVEIGRKKKNVAAKKESEEAETTEEAKKSNHVARKLEKRQQTRTLDSHIEEQFGGGRLLACISSRPGQCGRADGYILEGKELEFYMKKIQKKKGKSAA

SEQ ID NO: 13598 - protein, 231 aa, Ambrosia trifida
GISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKAAAAATKKEGEEAEAATEEAKKSNHVVRKLEKRQEERKLDPHVEEQFSSGRLLAAISSRPGQCGRADGYILEGKELEFYMKKLQKKKERVLLKPYSVSIFRFGFF

SEQ ID NO: 13599 - protein, 217 aa, Phaseolus vulgaris
MGISRDSMHKRRATGGKKKAWRKKRKYELGRQSANTKLSSNKTIRRIRVRGGNVKWRALRLDTGNYSWGSEAVTRKTRILDVVYNASNNELVRTQTLVKSAIVQVDAAPFKQWYLQHYGVEIGRKKKAASKKDSTEEADAAAEETKKSNHVQRKLEKRQKDRKLDAHIEEQFAGGRLLACISSRPGQCGRADGYILEGKELEFYMKKLQKKKGKGAA

SEQ ID NO: 13600 - protein, 217 aa, Beta vulgaris
MGISRDSMHKRRATGGKKKAWRKKRKYELGRQPANTKLSSNKTVRRVRVRGGNVKWRALRLDTGNFSWGSEAVTRKTRLLDVVYNASNNELVRTQTLVKSAIVQVDAAPFKQWYLQHYGVDVGRKKKAAAAAKKETEEGETTEEAKKSNHVARKLEKRQQNRTLDAHIEEQFGGGRLLACISSRPGQCGRADGYILEGKELEFYMKKIQRKKGKAAA

SEQ ID NO: 13601 - protein, 219 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAGATATKKEGEEAEAATEETKKSNHVVRKLEKRQEERKLDPHVEEQFSSGRLLAAISSRPGQCGRADGYILEGKELEFYMKKLQKKKGKGAA

SEQ ID NO: 13602 - protein, 105 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAYCSS

SEQ ID NO: 13603 - protein, 219 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAGATATKKEGEEVETAAEETKKSNHVVRKLEKRQEERKLDPHVEEQFSSGRLLAAISSRPGQCGRADGYILEGKELEFYMKKLQKKKGKGAA

SEQ ID NO: 13604 - protein, 219 aa, Guizotia abyssinica
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAATATKKEGEEAETATEEAKKSNHVVRKLEKRQEERKLDPHVEEQFSSGRLLAAISSRPGQCGRADGYILEGKELEFYMKKLQKKKGKGAA

SEQ ID NO: 13605 - protein, 219 aa, Actinidia deliciosa
MGISRDSMHKRRATGGKKKAWRKKRKYELGRQPANTKLSSNKTVRRVRVRGGNVKWRALRLDTGNFSWGSEAVTRKTRILDVVYNASNNELVRTQTLVKSAIIQVDAAPFKQWYLQHYGVDIGRKKKTAAAAAKKEGEEGEAATEEAKKSNHVVRKLEKRQQERKLDTHVEEQFGGGRLLAAISSRPGQCGRADGYILEGKELEFYMKKIQRKKGKGAA

SEQ ID NO: 13606 - protein, 220 aa, Lactuca sativa
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAPAASAAKKDGEEVEGATEETKKSNHVARKIEKRQEERKLDPHVEEQFSSGRLLAAVSSRPGQCGRADGYILEGKELEFYMKKLQKKKGKGAA

SEQ ID NO: 13607 - protein, 99 aa, Arachis hypogaea
MLPHSSSGTFSIMVLILAGRRKQLLPRRMLRKVRPPRRKPRKATMCREKSRNVRKIVSLIPILKSSLVVGDCWLALLLDLVNVAGLTAIFWKVRSLNFT

SEQ ID NO: 13608 - protein, 100 aa, Arachis hypogaea
MLLHSSSGTFSIMVLILAGRRKQQLPRRMLPRKVRPLQRKPRKATMCKEKSRNARKIANLIPILKSSLVVGDCWLALLLDLVNVAGLTATFWKVRSLNFT

SEQ ID NO: 13609 - protein, 224 aa, Arachis hypogaea
CFWFNQDGYFQGFYAQEARHWWQEEGLEEEEKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAAKKDAAEEGETPAEEAKKSNHVQRKIEKRQKDRKLDPHIEEQFGGGRLLACIASRPGQCGRADGYILEGKELEFYMKKIQKKKGKGAA

SEQ ID NO: 13610 - protein, 224 aa, Arachis hypogaea
CFWFSQDGYFQGFYAQEARHWWQEEGLEEEEKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAAKKDAAEEGETPAEEAKKSNHVQRKIEKRQKDRKLDPHIEEQFGGGRLLACIASRPGQCGRADGYILEGKELEFYMKKIQKKKGKGAA

SEQ ID NO: 13611 - protein, 110 aa, Tripterygium wilfordii
MGISRDSMHKRRSTGGKKKAWRKKRKYELGRQSANTKLSSNKTVRRIRVRGGNVKWRALRLDTGNYSWGSEAVTRKTRILDVVYNASNNELVRTQTLVKSAIVQVDAAPF

SEQ ID NO: 13612 - protein, 218 aa, Arachis hypogaea
MGISRDSMHKRRATGGKKKVWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKSATSGKKEGEDAETATEEVKKSNHVLRKLEKRKQTRVLDPHIEEQFGSGRLLASISSRPGQCGRADGYILEGKELEFYMKKLQKKKGKGAA

SEQ ID NO: 13613 - protein, 224 aa, Manihot esculenta
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAVKKETSEEGEGATATATAEETKKSNHVQRKLEKRQKDRKLDSHIEEQFGGGRLLACISSRPGQCGRADGYILEGKELEFYMKKIQRKKGKGAGAA

SEQ ID NO: 13614 - protein, 219 aa, Gossypium hirsutum
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEATEEGEVAVEETKKSNHVQRKHEKRQKERTLDAHIEEQFGSGRLLACISSRPGQCGRADGYILEGKELEFYMKKIQRKKGKGAGAA

SEQ ID NO: 13615 - protein, 223 aa, Vinca minor
MGISRDSMHKRRATGGKKKAWRKKRKYELGRQPANTKLSSNKTVRRIRVRGGNVKWRALRLDTGNYSWGSEAITRKTRILDVVYNASNNELVRTQTLVKSAIVQVDAAPFKQWYLQHYGVDIGRKKKAAAAAKKEGEEAEGGAATEEAKKSSNHVQRKIEKRQKDRTLDPHIEEQFGSGRLLACISSRPGQCGRSDGYILEGKELEFYMKKLQRKKGKSASAA

SEQ ID NO: 13616 - protein, 220 aa, Arabidopsis lyrata
MGISRDSIHKRRATGGKQKMWRKKRKYELGRQPANTKLSSNKTVRRIRVRGGNVKWRALRLDTGNFSWGSEAVTRKTRILDVAYNASNNELVRTQTLVKSAIVLVDAAPFKQGYLQHYGVDIGRKKKAAAAKKEGEEGDAVTTEEVKKSNHIQRKLEMRQEGRALDSHLEEQFSSGRLLACIASRPGQSGRADGYILEGKELEFYMKKLQKKKGKNAGAA

SEQ ID NO: 13617 - protein, 221 aa, Gerbera hybrid cultivar
MGISRDSMHKRRATGGKQKTWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKVAAAATKKEGEEAEGATEETKKSNHVVRKLEKRQEERKLDSHVEEQFSSGRLLAAISSRPGQCGRADGYILEGKELEFYMKKLQKKKGKSAGAA

SEQ ID NO: 13618 - protein, 220 aa, Populus trichocarpa
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAPAAKKEGEDGEAAVEEEKKSKHVQRKLEKRQQTRKLDPHIEEQFGGGRLLASISSRPGQCGRADGYILEGKELEFYMKKIQRKKGKGAGAA

SEQ ID NO: 13619 - protein, 221 aa, Tabernaemontana elegans
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYVQHYGVDIGRKKKAAATKKEGEEGEGTAATEETKKSNHVLRKLEKRQKDRKLDAHIEEQFGSGRLLACISSRPGQCGRADGYILEGKELEFYMKKIQRKKGKSAGAA

SEQ ID NO: 13620 - protein, 222 aa, Vinca minor
MGISRDSMHKRRETGGKKKAWRKKRKYELGRQPANTKLSSNKTVRRIRVRGGNVKWRALRLDTGNYSWGSEAVTRKTRILDVVYNASNNELVRTQTLVKSAIIQVDAAPFKQWYLQHYGVDIGRKKKAATAKKEGEEAEGVAAATEEAKKSNHVQRKIEKRQKDRTLDPHIEEQFGSGRLLACISSRPGQCGRSDGYILEGKELEFYMKKLQKKKGKSAGTA

SEQ ID NO: 13621 - protein, 221 aa, Vinca minor
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIIQVDAAPFKHWYLQHYGVDIGRKKKATATKKEGEEAEGAAATEETKKSNHVQRKIEKRQKDRALDPHIEDQFGSGRLFACISSRPGQCGRADGYILEGKELEFYMKKLQRKKGKSAGAA

SEQ ID NO: 13622 - protein, 218 aa, Phaseolus vulgaris
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGLDIGRKKKTAAKKDSAEEGDAAAAEEAKKSNHVQRKLEKRQKDRKLDAHIEEQFAGGRLLACISSRPGQCGRCDGYILEGKELEFYMKKLQKKKGKGAA

SEQ ID NO: 13623 - protein, 219 aa, Arnica chamissonis
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAASTATKKEGEEVETATEEAKKSNHVVRKLEKRQEERKLDPHVEEQFSSGRLLAAISSRPGQCGRADGYILEGKELEFYMKKLQKKKGKGAA

SEQ ID NO: 13624 - protein, 225 aa, Hordeum vulgare
MGISRDSMHKRRATGGKQKAWRKKRKYELGRQPANTKLSSNKTVRRVRVRGGNVKWRALRLDTGNFSWGSEATTRKTRLLDVVYNSSNNELVRTQTLVKNAIVQVDAAPFKQWYLTHYGVEIGRKKKAAAAAKKDAAEGQEAEVAAAATEEAKKSNKVQRKLEKRQQGRTLDSHIEEQFSGGRLLACISSRPGQCGRADGYILEGKELEFYMRKLQKKKGKGATA

SEQ ID NO: 13625 - protein, 217 aa, Beta vulgaris
MGISRDSMHKRRATGGKKKAWRKKRKYELGRQPANTKLSSNKTVRRVRVRGGNVKWRALRLDTGNFSWGSEAVTRKTRLLDVVYNASNNELVRTQTLVKSAIVQVDAAPFKQWYLQHYGVEIGRKKKAAASAKKEAEEGETTEEAKKSNHVARKLEKRQQTRTLDAHIEEQFGGGRLLACISSRPGQCGRADGYILEGKELEFYMKKIQRKKGKAAA

SEQ ID NO: 13626 - protein, 217 aa, Cyamopsis tetragonoloba
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAASKKDTTEEGEAAAEETKKSNHVQRKLEKRQKERNLDSHIEEQFGGGRLLACISSRPGQCGRADGYILEGKELEFYMKKLQRKKGKGAA

SEQ ID NO: 13627 - protein, 219 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKGAAAATKKEGEEAETTTEEAKKSNHVVRKLEKRQEDRKLDPHVEEQFSSGRLLAAISSRPGQCGRADGYILEGKELEFYMKKLQKKKGKGAA

SEQ ID NO: 13628 - protein, 219 aa, Flaveria ramosissima
GISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKTAASAGKKEGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13629 - protein, 221 aa, Setaria italica
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDGAEGQEGEAAAEETKKSNHVQRKLEKRKDGRALDPHIEEQFGSGRLLACIASRPGQCGRADGYILEGKELEFYMKKLQKKKGKGAAA

SEQ ID NO: 13630 - protein, 219 aa, Citrus sinensis
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAVTKKETTEEGEGAAAAAEETKKSNHVVRKLEKRQKDRTLDPHIEEQFGAGRLLACISSRPGQCGRADGYILEGKELEFYMKKLQRKKGKGA

SEQ ID NO: 13631 - protein, 221 aa, Cajanus cajan
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKSAAKKDSAEEGDATAVATAEESKKSNHVQRKLEKRQKDRSLDPHIEEQFGGGRLLASISSRPGQCGRADGYILEGKELEFYMKKLQRKKGKGAA

SEQ ID NO: 13632 - protein, 226 aa, Secale cereale
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 13633 - protein, 221 aa, Saccharum officinarum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKESAEGQEGEAAAEETKKSNHVKRKLEERQKGRELDAHIEEQFGSGRLLACISSRPGQCGRADGYILEGKELEFYMKKLQRKKGKGAAA

SEQ ID NO: 13634 - protein, 219 aa, Helianthus annuus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKASVTATKKEGEEAEAAAEEAKKSNHVVRKLEKRQEERKLDPHVEEQFSSGRLLAAISSRPGQCGRADGYILEGKELEFYMKKLQKKKGKGAA

SEQ ID NO: 13635 - protein, 221 aa, Panicum virgatum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDVAPFKQWYLTHYGVDIGRKKKAAAAKKDAAEGQEGEAAAEEARKSNHVQRKLEKRQQGRTLDPHIEEQFGSGRLLACISSRPGQCGRADGYILEGKELEFYMKKLQRKKGKGAAA

SEQ ID NO: 13636 - protein, 225 aa, Triticum aestivum
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 13637 - protein, 206 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAATATKKEGEEVEAATEETKKSNHVVRKLEKRQEERKLDPHVEEQFSSGRLLAAISSRPGNAVALMDTYWKVRSLSST

SEQ ID NO: 13638 - protein, 53 aa, Arachis hypogaea
MGISRDSMHKRRATGGKKKVWRKKRSMSLEGNQQTQSSPATKLLGGSGFEVGM

SEQ ID NO: 13639 - protein, 109 aa, Secale cereale
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAP

SEQ ID NO: 13640 - protein, 207 aa, Panicum virgatum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAARVKRVRPQLRKPRRVTMSRGSLRSASRDAHLTRTLRSNLEVEGCWHALLLALGSVAELTVTSLRVKSSSST

SEQ ID NO: 13641 - protein, 221 aa, Capsicum annuum
MGISRDSMHKRRATGGKKKAWRKKRKYEMGRQSANTKLVHNAKTVRRIRVRGGNVKWRALRLDTGNYSWGSEAVTRKTRLLDVVYNASNNELVRTQTLVKSAIVQVDAAPFKQWYLQHYGVEVGRKKKSAAKKEGEEAPEAAAEEKKSNHVQRKLEKRQQDRKIDPHVEEQFASGRLLAAISSRPGQCGRADGYILEGKELEFYMKKLQKKKGKGASGATA

SEQ ID NO: 13642 - protein, 223 aa, Unknown
  Sequence found in Organisms: Solanum tuberosum, Solanum phureja
MGISRDSMHKRRATGGKQKTWRKKRKYELGRQSANTKISSNKTVRRIRVRGGNVKWRALRLDTGNYSWGSEAVTRKTRILDVVYNASNNELVRTQTLVKSAIVQVDAAPFKQWYLQHYGVDIGRKKKGAAKKETTTEEGEAAAPAEEAKKSNHVVRKIEKRQKDRTLDSHLEEQFSSGRLYACISSRPGQCGRADGYILEGKELEFYMKKLQKKKGKASGASA

SEQ ID NO: 13643 - protein, 226 aa, Euphorbia peplus
PLGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGLDIGRKKKAVAAKKETTEEGDGAAPAAQVEETKKSNHVARKIEKRQKDRKLDSHIEEQFGGGRLLACISSRPGQCGRADGYILEGKELEFYMKKLQKKKGKGASAA

SEQ ID NO: 13644 - protein, 222 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKTAAAAKKDGEETEAAAAAEEAKKSNHVKRKIEKRQEERKIDAHIEEQFGGGRLLASISSRPGQCGRADGYILEGKELEFYMKKLQRKKGKGAGGV

SEQ ID NO: 13645 - protein, 222 aa, Aristolochia fimbriata
MGISRDSMHKRRATGGKKKAWRKKRKYELGRQPANTKLSSNKTVRRVRVRGGNVKWRALRLDTGNYSWGSEAVTRKTRVLDVVYNASNNELVRTQTLVKNAIVQVDAAPFKQWYLQHYGVDIGRKKKASQTVKKEGEEGEAATQEEAKKSNHVVRKLEKRQQGRTLDPHIEEQFGSGRLLACISSRPGQCGRADGYILEGKELEFYTKKIHRKKGKGTASAA

SEQ ID NO: 13646 - protein, 222 aa, Aristolochia fimbriata
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKVSQVVKKEGEDGESAPQEEAKKSNHVVRKLEKRQQGRSLDPHIEEQFGSGRLLASISSRPGQCGRADGYILEGKELEFYMKKIQRKKGKGSAGAA

SEQ ID NO: 13647 - protein, 219 aa, Manihot esculenta
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDVGRKKKTAAVKKEGEEGEATTDEVKKSNHVMRKLEKRQQTRKLDPHIEEQFGGGRLLACISSRPGQCGRADGYILEGKELEFYMKKLQRKKGKGAGAA

SEQ ID NO: 13648 - protein, 219 aa, Ricinus communis
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIIQVDAAPFKQWYLQHYGVDIGRKKKTAAAKKEGEEGEAATEEVKKSNHVLRKLEKRQQIRKLDPHIEEQFGGGRLLACISSRPGQCGRADGYILEGKELEFYMKKLQRKKGKGAGAA

SEQ ID NO: 13649 - protein, 221 aa, Cirsium arvense
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKPAAAAIKKEGEEAEVATEETKKSNHVVRKLEKRQEERKLDQHVEEQFSGGRLLAAISSRPGQCGRADGYILEGKELEFYMKKLQKKKGKSGGAA

SEQ ID NO: 13650 - protein, 223 aa, Cucurbita pepo
MGISRDSMHKRRATGGKKKAWRKKRKYELGRQPANTKISSDKSIRRIRVRGGNVKWRAFRLDTGNYSWGSEAVTRKTRILDVVYNASNNELVRTQTLVKSAIVQVDAAPFKQWYLQHYGVDIGRKKKTAASAKKEEEGDAAAAAATEEAKKSNHVQRKLEKRQQERKLDPHIEEQFSSGRLMACISSRPGQCGRADGYILEGKELEFYMKKLQRKKGKGAGAA

SEQ ID NO: 13651 - protein, 220 aa, Gerbera hybrid cultivar
MGISRDSMHKRRATGGKQKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKATTAAKKEGEEVEGPTEETKKSNHVVRKLEKRQEERKLDQHVEEQFSSGRLLAAISSRPGQCGRADGYILEGKELEFYMKKLQKKKGKSAGAA

SEQ ID NO: 13652 - protein, 219 aa, Jatropha curcas
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKVAATKKEGEEGEGATEEVKKSNHVLRKLEKRQQTRKLDPHIEEQFAGGRLMACISSRPGQCGRADGYILEGKELEFYMKKIQRKKGKGAGAA

SEQ ID NO: 13653 - protein, 220 aa, Tropaeolum majus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDVGRKKKTAVSAKKEGEEGEAVSEEAKKSNHVARKLEKRQQTRELDSHIEEQFSGGRLLACIASRPGQCGRADGYILEGKELEFYMKKLQKKKGKGAGAA

SEQ ID NO: 13654 - protein, 219 aa, Capsicum annuum
MGISRDSMHKRRATGGKQKAWRKKRKYELGRQPGNTKISSNKTVRRIRVRGGNVKWRALRLDTGNYSWGSEATTRKTRILDVVYNASNNELVRTQTLVKSAIVQVDAAPFKQWYLQHYDVDIGRKKKAAAKKETAEEGEGAAAAETKKSNHVLRKIEKRQADRKLDSHLEEQFGSGRLLACISSRPGQCGRADGYILEGKELEFYMKKLQKKKGKAAAA

SEQ ID NO: 13655 - protein, 223 aa, Phalaenopsis aphrodite
MGISRDSLHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVELGRKKKSTAASKKDSSEVHDGEAAQEESKKSNHVERKLEKRQQVRTLDPHIEEQFGSGRLLASISSRPGQCGRADGYILEGKELEFYLKKIQRKKGKSAGAA

SEQ ID NO: 13656 - protein, 224 aa, Plantago ovata
MGISRDSMHKRRATGGKKKAWRKKREYELGRQPANTKLSSNKTVRRVRVRGGNVKWRALRLDTGNFSWGSEAVTRKTRILDVVYNASNNELVRTQTLVKGAIIQVDAAPFKQWYLQHYGVDVGRKKKSAATKKEVTEEAADANAAAEETKKSNHVVRKIEKRQEGRTLDSHLEEQFGSGRLYACISSRPGQCGRSDGYILEGKELEFYMKKLQKKKGKGAGAAA

SEQ ID NO: 13657 - protein, 220 aa, Rhizophora mangle
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGVDIGRKKKTVTATKKEGEEGEATTEEAKKSNHVLRKLEKRQQNRQLDSHIEEQFGSGRLLACISSRPGQCGRADGYILEGKELEFYMKKIQRKKGKGAGAA

SEQ ID NO: 13658 - protein, 222 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKTAAAAKKDGEETEAAAAAEEAKKSNHVKRKIEKRQEERKIDAHIEEQFGGGRLLASISSRPGQCGRADGYILEGKELEFYMKKLQRKKGKGASGA

SEQ ID NO: 13659 - protein, 140 aa, Panicum virgatum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAGSRG

SEQ ID NO: 13660 - protein, 220 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAAKKEGEEGDVPIEEAKKSKHVLRKIEKRQEDRKIDAHIEEQFGGGRLLAAISSRPGQCGRADGYILEGKELEFYVKKLQRKKGKGAAA

SEQ ID NO: 13661 - protein, 217 aa, Glycine max
MGISRDSMHKRRATGGKKKAWRKKRKYELGRQAANTKLSSNKTIRRIRVRGGNVKWRALRLDTGNYSWGSEAVTRKTRILDVVYNASNNELVRTQTLVKSAIVQVDAAPFRQWYLQHYGVEIGRKKKVAAKKDSTEEGEAAAEETKKSNHVQRKLEKRQKDRNLDSHIEEQFGGGRLLACISSRPGQCGRADGYILEGKELEFYMKKLQRKKGKGAA

SEQ ID NO: 13662 - protein, 217 aa, Cirsium arvense
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKVAAKKEGEEAEAATEEAKKSNHVVRKLEKRQEERKLDPHVEEQFSGGRLLAAISSRPGQCGRADGYILEGKELEFYMKKLQKKKGKGAAA

SEQ ID NO: 13663 - protein, 218 aa, Vigna unguiculata
MGISRDSMHKRRATGGKKKAWRKKRKYELGRQSANTKLSSNKTIRRIRVRGGNVKWRALRLDTGNYSWGSEAVTRKTRILDVVYNASNNELVRTQTLVKSAIVQVDAAPFKQWYLQHYGVDIGRKKKAATKKDSTEEGDAAAAEETKKSNHVQRKIEKRQKDRKLDAHIEEQFGGGRLLACISSRPGQCGRADGYILEGKELEFYMKKLQKKKGKGAA

SEQ ID NO: 13664 - protein, 220 aa, Solanum melongena
MGISRDSMHKRRATGGKQKTWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAAKKETAEEGEGAAAEETKKSNHVLRKIEKRQVDRKLDPHLEEQFSSGRLYACISSRPGQCGRADGYILEGKELEFYMKKLQKKKGKAGAA

SEQ ID NO: 13665 - protein, 220 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAASTTKKEGEEAEGATEEAKKSNHVVRKLEKRQEDRKLDPHVEEQFSSGRLLAAISSRPGQCGRADGYILEGKELEFYMKKLQKKKGKGAAA

SEQ ID NO: 13666 - protein, 221 aa, Pennisetum glaucum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAAAAKKDTAEGQEGEAAAEELKKSNHVKRKLEKRKEARALDAHIEEQFSSGRLLACIASRPGQCGRADGYILEGKELEFYMKKLQKKKGKGAAA

SEQ ID NO: 13667 - protein, 218 aa, Mimulus guttatus
MGISRDSMHKRRETGGKKKAWRKKRKYELGRQPANTKLSSNKTVRRVRVRGGNVKWRALRLDTGNFSWGSEAVTRKTRILDVVYNASNNELVRTKTLVKSAIIQVDAAPFKQWYLQHYGVDISRKKKAAVKKEGEEAEAAATEEAKKSNHVQRKIEKRQEERKIDTHIEEQFGSGRLLAAISSRPGQCGRADGYILEGKELEFYMKKIQKKKGKGATA

SEQ ID NO: 13668 - protein, 225 aa, Avena sativa
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKAPAAAKKEASEGQEGEVAAVAAEEAKKSNNVQRKLEKRQQGRTLDSHIEEQFSGGRLLACISSRPGQCGRADGYILEGKELEFYMRKLQKKKGKGAAA

SEQ ID NO: 13669 - protein, 218 aa, Populus trichocarpa
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGIDIGRKKKTTAAKKEGEEGEAVTEEVKKSNHVLRKLEKRQQIRKLDPHIEEQFGSGRLLASISSRPGQCGRADGYILEGKELEFYLKKIQRKKGKGAGA

SEQ ID NO: 13670 - protein, 221 aa, Solanum tuberosum
MGISRDSMHKRRATGGKQKTWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAAKKETAEEGEGAAAAEETKKSNHVLRKIEKRLTDRKLDSHLEEQFSSGRLYACISSRPGQCGRADGYILEGKELEFYMKKLQKKKGKAAAA

SEQ ID NO: 13671 - protein, 221 aa, Oryza sativa
MGISRDSMHKRRATGGKQKAWRKKRKYELGRQPANTKLSSNKTVRRVRVRGGNLKWRALRLDTGNYSWGSEAVTRKTRILDVVYNASNNELVRTQTLVKSAIVQVDAAPFKQWYLTHYGVDIGRKKKAPAAKKDAAEGQEGEAATEEAKKSNHVVRKLEKRQQTRTLDSHIEEQFGSGRLLACISSRPGQCGRADGYILEGKELEFYMKKLQRKKGKGAAA

SEQ ID NO: 13672 - protein, 221 aa, Solanum phureja
MGISRDSMHKRRATGGKQKTWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAAKKETAEEGESAAAAEETKKSNHVLRKIEKRLADRKLDSHLEEQFSSGRLYACISSRPGQCGRADGYILEGKELEFYMKKLQKKKGKAAAA

SEQ ID NO: 13673 - protein, 220 aa, Solanum lycopersicum
MGISRDSMHKRRATGGKQKTWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAAKKETAEEGEGAAAEETKKSNHVLRKIEKRQAERKLDSHLEEQFSSGRLYACISSRPGQCGRADGYILEGKELEFYMKKLQKKKGKAAAA

SEQ ID NO: 13674 - protein, 221 aa, Tragopogon dubius
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPAVSATKKEGEEAEGAATEEAKKSNHVVRKLEKRQEERKLDAHVEEQFSSGRLLAAISSRPGQCGRADGYILEGKELEFYMKKLQKKKGKGAAA

SEQ ID NO: 13675 - protein, 147 aa, Cicer arietinum
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTASKKDTPGGRSCYRRSQKE

SEQ ID NO: 13676 - protein, 153 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAASTTKKEGEEAEGATEEAKRVIML

SEQ ID NO: 13677 - protein, 236 aa, Flaveria ramosissima
MGTSRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAASTTKKEGEEAEGATEEAKKSNHVVRKLEKRQEDRKLDPHVEEQFSSGRLLAAISSRPGQCGRADGYILEGKELEFYMKKLQKKKGKGAAAQDHISLDRFVFLLFIF

SEQ ID NO: 13678 - protein, 215 aa, Medicago truncatula
MGISRDSMHKRRETGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDIGRKKKNVSKKEEEAEAATEEVKKSAHVQRKLEQRQKERQLDAHIEEQFGGGRLLACISSRPGQCGRADGYILEGKELEFYMKKLQKKKGKGAA

SEQ ID NO: 13679 - protein, 219 aa, Arnica chamissonis
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAVATATKKEGEEAETATEETKKSNHVVRKLEKRQEERKLDPHVEEQFSSGRLLAAVSSRPGQCGRADGYILEGKELEFYMKKLQKKKGKGAA

SEQ ID NO: 13680 - protein, 219 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKGAAAAPKKEGEDAEGATEEAKKSNHVVRKLEKRQEERKLDAHVEEQFSGGRLYAAISSRPGQCGRADGYILEGKELEFYMKKLQKKKGKGAA

SEQ ID NO: 13681 - protein, 219 aa, Centaurea maculosa
  misc_feature (8)..(8): Xaa can be any naturally occurring amino acid
MGISRDSXHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKGAAAAPKKEGEDAEGATEEAKKSNHVVRKLEKRQEERKLDAHVEEQFSGGRLYAAISSRPGQCGRADGYILEGKELEFYMKKLQKKKGKGAA

SEQ ID NO: 13682 - protein, 217 aa, Cichorium intybus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTTATKKEGEEVEGATEETKKSNHVARKIEKRQEDRKLDPHVEEQFSSGRLLAAISSRPGQCGRADGYILEGKELEFYMKKLQKKKGKGAA

SEQ ID NO: 13683 - protein, 219 aa, Cirsium arvense
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKPSATATKKEGEEAEAATEEAKKSNHVVRKLEKRQEERKLDPHVEEQFSGGRLLAAISSRPGQCGRADGYILEGKELEFYMKKLQKKKGKGAA

SEQ ID NO: 13684 - protein, 218 aa, Vigna unguiculata
MGISRDSMHKRRATGGKKKAWRKKRKYELGRQPANTKLSSNKTIRRIRVRGGNVKWRALRLDTGNYSWGSEAVTRKTRILDVVYNASNNELVRTQTLVKSAIVQVDAAPFKQWYLQHYGVDIGRKKKTVAKKDSAEEGEAAAAEEAKKSNHVQRKLEKRQKDRKLDAHIEEQFGGGRLLACIASRPGQCGRADGYILEGKELEFYMKKLQKKKGKGAA

SEQ ID NO: 13685 - protein, 219 aa, Taraxacum officinale
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAPVSATKKEGEEVEGGTEETKKSNHVVRKLEKRQEERKLDAHVEEQFSSGRLLAAISSRPGQCGRADGYILEGKELEFYMKKLQKKKGKGAA

SEQ ID NO: 13686 - protein, 218 aa, Citrus sinensis
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAVTKKETTEEGEGAAAAAEETKKSNHVVRKLEKRQKDRTLDPHIEEQFGAGRLLACISSRPGQCGRADGYILEGKELEFYMKKLQRKKGKG

SEQ ID NO: 13687 - protein, 217 aa, Papaver somniferum
MGISRDSMHKRRATGGKKKAWRKKRKYELGRQPANTKLSSNKTVRRVRVRGGNVKWRALRLDTGNYSWGSETVTRKSRILDVVYNASNNELVRTQTLVKGAIVQVDAAPFKQWYLQHYGLDIGRKKKNTSAKKEGEEAEAVAEEAKKSNHLLRKIESRQEDHKLDSHIEEQFSGGRLLACISSRPGQCGRADGYILEGKELEFYQKKLQKKKGKGAA

SEQ ID NO: 13688 - protein, 222 aa, Aquilegia formosa
MGISRDSIHKRRATGGKQKVWRKKRKYELGRQPANTKLSSNKTVRRIRVRGGNVKWRALRLDTGNFSWGSEAVTRKTRVLDVVYNASNNELVRTQTLVKGAIIQVDAAPFRQWYLQHYGQDIGRKKKGAAAAAKKEGEEAETVAEEAKKSNHVQRKIEKRQEDKKLDAHIEEQFSGGRLLAAISSRPGQCGRCDGYILEGKELEFYMKKIQRKKGKGSAGAA

SEQ ID NO: 13689 - protein, 219 aa, Heritiera littoralis
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEASEEGEGAAEETKKSNHVQRKLEKRQKDRKLDTHIEEQFGAGRLLACISSRPGQCGRADGCILEGKELEFYMKKIQRKKGKGAGAA

SEQ ID NO: 13690 - protein, 222 aa, Prunus persica
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTAAAAKKDTPEEGEATTEEAKKSNHVARKLEKRQQGRTLDGHIEEQFGGGRLLACISSRPGQCGRADGYILEGKELEFYMKKLQRKKGKGAGAAA

SEQ ID NO: 13691 - protein, 222 aa, Cenchrus ciliaris
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAAKKDTAEGQEGEAAAEEAKKSNHVKRKLEKRKEARALDAHIEEQFSSGRLLACIASRPGQCGRADGYILEGKELEFYMKKLQKKKGKGAAA

SEQ ID NO: 13692 - protein, 222 aa, Cenchrus ciliaris
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAAKKDTAEGQEGEAAAEELKKSNHVKRKLEKRKEARALDAHIEEQFSSGRLLACIASRPGQCGRADGYILEGKELEFYMKKLQKKKGKGAAA

SEQ ID NO: 13693 - protein, 221 aa, Cenchrus ciliaris
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGLDIGRKKKAPAAKKDGAEGQEAEAAADETKKSNHVKRKLEKRKEGHKLDPHIEEQFGSGRLLACIASRPGQCGRADGYILEGKELEFYMKKLQKKKGKGAAA

SEQ ID NO: 13694 - protein, 219 aa, Unknown
  Sequence found in Organisms: Echinacea purpurea, Helianthus annuus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAAAVKKDGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13695 - protein, 225 aa, Festuca arundinacea
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTTAAAKKDAAEGQEGEVAAAATEEAKKSNNVQRKLEKRQQGRTLDAHIEEQFSSGRLLACISSRPGQCGRADGYILEGKELEFYTRKLQKKKGKGAAA

SEQ ID NO: 13696 - protein, 225 aa, Festuca arundinacea
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTPAVAKKDAAEGQEGEVAAAATEEAKKSNNVQRKLEKRQQGRTLDSHIEEQFSSGRLLACISSRPGQCGRADGYILEGKELEFYTRKLQKKKGKGAAA

SEQ ID NO: 13697 - protein, 225 aa, Festuca arundinacea
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTPAAAKKDAAEGQEGEVAAAATEEAKKSNNVQRKLEKRQQGRTLDAHIEEQFSSGRLLACISSRPGQCGRADGYILEGKELEFYTRKLQKKKGKGAAA

SEQ ID NO: 13698 - protein, 220 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAAAKKGEEGDVPIEEAKKSKHVLRKIEKRQEDRKIDAHIEEQFGGGRLLAAISSRPGQCGRADGYILEGKELEFYVKKLQRKKGKGAAA

SEQ ID NO: 13699 - protein, 221 aa, Oryza sativa
MGISRDSMHKRRATGGKQKAWRKKRKYELGRQPANTKLSSNKTVRRVRVRGGNLKWRALRLDTGNYSWGSEAVTRKTRILDVVYNASNNELVRTQTLVKSAIVQVDAAPFKQWYLTHYGVDIGRKKKAPAAKKDAAEGQEGEAATEEAKKSNHVVRKLEKRQQTRTLDAHIEEQFGSGRLLACISSRPGQCGRADGYILEGKELEFYMKKLQRKKGKGAAA

SEQ ID NO: 13700 - protein, 217 aa, Glycine max
MGISRDSMHKRRATGGKKKAWRKKRKYELGRQAANTKLSSNKTIRRIRVRGGNVKWRALRLDTGNYSWGSEAVTRKTRILDVVYNASNNELVRTQTLVKNAIVQVDAAPFKQWYLQHYGVEIGRKKKVASKKDSTEEGEAAAEETKKSNHVQRKLEKRQKDRKLDSHIEEQFGGGRLLACISSRPGQCGRADGYILEGKELEFYMKKLQRKKGKGAA

SEQ ID NO: 13701 - protein, 223 aa, Triphysaria pusilla
MGISRDSMHKRRSTGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAASAKKDGEETEAAAAAEEAKKSNHVKRKIEKRQEERKIDAHIEEQFGGGRLLAAISSRPGQCGRADGYILEGKELEFYMKKLQRKKGKGAGGV

SEQ ID NO: 13702 - protein, 222 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAASAKKDGEETEAAAAEEAKKSNHVKRKIEKRQEERKIDAHIEEQFGGGRLLAAISSRPGQCGRADGYILEGKELEFYMKKLQRKKGKGASGV

SEQ ID NO: 13703 - protein, 220 aa, Solanum lycopersicum
MGISRDSMHKRRATGGKQKTWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAAKKETAEEGDGAATEETKKSNHVLRKIEKRQAERKLDSHLEEQFSSGRLYACISSRPGQCGRADGYILEGKELEFYMKKLQKKKGKAAAA

SEQ ID NO: 13704 - protein, 218 aa, Amborella trichopoda
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFRQWYLQHYGIDIGRKKKTGAAKKEGEEGEAAIEEVNKSKHVLRKLEKRQEGHKLDPHIEEQFGGGRLLACISSRPGQCGRADGYILEGKELEFYMKKIQRKKGKGASA

SEQ ID NO: 13705 - protein, 219 aa, Antirrhinum majus
MGISRDSMHKRRATGGKKKAWRKKRKYELGRQPANTKLSSNKTVRRVRVRGGNVKWRALRLDTGNYSWGSEAVTRKTRVLDVVYNASNNELVRTQTLVKGAIVQVDAAPFKQWYLQHYGVEIGRKKKTAAKKEGEEAEATATEEVKKSNHVQRKIEKRQQERKIDAHIEEQFGGGRLLAAISSRPGQCGRCDGYILEGKELEFYMKKLQRKKGKGAGGA

SEQ ID NO: 13706 - protein, 220 aa, Arnica chamissonis
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKTVTPAGKKEGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13707 - protein, 219 aa, Persea americana
MGISRDSMHKRRATGGKKKAWRKKRKYELGRQPANTKLSSNKTVRRVRVRGGNVKWRALRLDTGNYSWGSEAVTRKTRVLDVVYNASNNELVRTQTLVKSAIVQVDAAPFKQWYLQHYGVDIGRKKKAPAVKKEAAEEGEGATEEVKKSNHVTRKLEKRVQGHKLDPHIEEQFSGGRLLAAISSRPGQCGRADGYILEGKELEFYMKKIQRKKGKGAAA

SEQ ID NO: 13708 - protein, 221 aa, Catharanthus roseus
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQWYLQHYGVDIGRKKKAAATKKEGEEAEGGAATEETKKSNHVVRKLEKRQKDRKLDHHIEEQFGSGRLLACISSRPGQCGRADGYILEGKELEFYMKKLQRKKGKSAGAA

SEQ ID NO: 13709 - protein, 222 aa, Castanea mollissima
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDVGRKKKATTKKETAEEGEGAATATEETKKSNHVQRKIEKRQKDRQLDPHIEEQFGSGRLLACISSRPGQCGRADGYILEGKELEFYMKKLQRKKGKAGAGA

SEQ ID NO: 13710 - protein, 221 aa, Cichorium intybus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKQAPSATKKEGEEGEGATEEAKKSNHVVRKLEKRQEERKLDPHVEEQFSSGRLLAAISSRPGQCGRADGYILEGKELEFYMKKLQKKKGKGAGTA

SEQ ID NO: 13711 - protein, 222 aa, Cucumis sativus
MGISRDSMHKRRATGGKKKAWRKKRKYELGRQPANTKLSSDKSIRRIRVRGGNVKWRAFRLDTGNYSWGSEAVSRKTRILDVVYNASNNELVRTQTLVKSAVVQVDAAPFKQWYLQHYGVDIGRKKKTAASAKKDEEGDAAAAAAEEVKKSNHVQRKLEKRQEGRKLDPHIEEQFSSGRLMACISSRPGQCGRADGYILEGKELEFYMKKLQRKKGKGAGAA

SEQ ID NO: 13712 - protein, 220 aa, Taraxacum officinale
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKVVPSATKKEGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13713 - protein, 220 aa, Flaveria ramosissima
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAASSGKKEGEEAEGATEEAKKSNHVVRKLEKRQEERKLDPHVEEQFSSGRLLAAISSRPGQCGRADGYILEGKELEFYMKKLQKKKGKGASA

SEQ ID NO: 13714 - protein, 219 aa, Flaveria ramosissima
GISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAASTTKKEGEEAEGATEEAKKSNHVVRKLEKRQEDRKLDPHVEEQFSSGRLLAAISSRPGQCGRADGYILEGKELEFYMKKLQKKKGKGAAA

SEQ ID NO: 13715 - protein, 221 aa, Lactuca sativa
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVEIGRKKKPAPSATKKEGEEVEGATEEAKKSNHVVRKLEKRQEERKLDQHVEEQFSSGRLLAAISSRPGQCGRADGYILEGKELEFYMKKLQKKKGKGAGTA

SEQ ID NO: 13716 - protein, 220 aa, Tropaeolum majus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDVGRKKKAAATKKDTQEEGEATTEEAKKSNHVVRKIEKRQQDRKLDAHIEEQFGGGRLLACISSRPGQCGRADGYILEGKELEFYMKKLQKKKGKSAGAA

SEQ ID NO: 13717 - protein, 220 aa, Tropaeolum majus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDVGRKKKTVAAKKDTQEEGEATVTEEAKKSNHVVRKIEKRQQERKLDAHIEEQFGGGRLLACIASRPGQCGRADGYILEGKELEFYMKKLQKKKGKGAAA

SEQ ID NO: 13718 - protein, 225 aa, Avena sativa
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKAPAAGKKEASEGQEGEVAAAATEEAKKSNNVQRKLEKRQQGRTLDSHIEEQFSGGRLLACISSRPGQCGRADGYILEGKELEFYMRKLQKKKGKGAAA

SEQ ID NO: 13719 - protein, 224 aa, Avena sativa
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTPAAKKEASEGQEGEAAAVATEEAKKSNNVQRKLEKRQQGRTLDSHIEEQFSGGRLLACISSRPGQCGRADGYILEGKELEFYMRKLQKKKGKGAAA

SEQ ID NO: 13720 - protein, 222 aa, Allium cepa
MGISRDSMHKRRATGGKKKAWRKKRKYEMGRQPANTKLSSNKTVRRIRVRGGNVKWRALRLDTGNYSWGSEAVTRKTRILDVVYNASNNELVRTQTLVKSAIVQVDAAPFKQWYLTHYGVDIGRKKKAVATGKKEATATEESEPVAEVKKSDHVKRKLEKRQKERTLDSHIEEQFGSGRLLACISSRPGQCGRADGYILEGKELEFYMKKLQKKKGKAAAAS

SEQ ID NO: 13721 - protein, 222 aa, Orobanche aegyptiaca
MGISRDSMHKRRATGGKKKVWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEVGRKKKTTAAAAKKEGEETEAAATVEVEKSNHLQRKLEKRQQDRKIDSHIEEQFGGGRLLAAISSRPGQCGRADGYILEGKELEFYMKKLQKKKGKGAGAA

SEQ ID NO: 13722 - protein, 217 aa, Pteridium aquilinum
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEATEEGEGVAEETKKSNHVVRKLEKRQKDRKLDAHIEEQFGAGRLLACISSRPGQCGRADGYILEGKELEFYTNKIQRKKGKGAG

SEQ ID NO: 13723 - protein, 219 aa, Sesamum indicum
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIIQVDAAPFKQWHLQHYGVDIGRKKKTAAKKEGEEAEAAATEEVKKSNHVQRKIEKRQQDRKIDPHIEEQFSSGRLLAAISSRPGQCGRADGYILEGKELEFYMKKLQRKKGKGASGA

SEQ ID NO: 13724 - protein, 220 aa, Helianthus annuus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTVAATTKKEGEEAEGATEEAKKSNHVVRKLEKRQEERKLDPHVEEQFSSGRLLAAISSRPGQCGRADGYILEGKELEFYMKKLQKKKGKGAAA

SEQ ID NO: 13725 - protein, 216 aa, Trigonella foenum-graecum
MGISRDSMHKRRETGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTVGKKEEEAEAATEEVKKSAHVQRKLEQRQKDRQLDAHIEEQFGGGRLLACISSRPGQCGRADGYILEGKELEFYMKKLQKKKGKGAAA

SEQ ID NO: 13726 - protein, 222 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAAAKKDGEETEAAAAAEEAKKSNHVKRKIEKRQEERKIDAHIEEQFGGGRLLAAISSRPGQCGRADGYILEGKELEFYMKKLQRKKGKGAGGA

SEQ ID NO: 13727 - protein, 222 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKTAAAAKKDVEETEAAAAAEEAKKSNHVKRKIEKRQEERKIDAHIEEQFGGGRLLAAISSRPGQCGRADGYILEGKELEFYMKKLQRKKGKGAGGA

SEQ ID NO: 13728 - protein, 221 aa, Setaria italica
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEAAAEETKKSNHVTRKLEKRKVGRQLDPHIEEQFGSGRLLACIASRPGQCGRADGYILEGKELEFYMKKLQKKKGKGAAA

SEQ ID NO: 13729 - protein, 219 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPSATAAKKEGEEAEAATEEAKKSNHVVRKLEKRQEERKLDGHVEEQFSGGRLYAAISSRPGQCGRADGYILEGKELEFYMKKLQKKKGKGAA

SEQ ID NO: 13730 - protein, 212 aa, Chenopodium quinoa
DSMHKRRATGGKKKAWRKKRKYELGRQPANTKLSSNKTVRRVRVRGGNVKWRALRLDTGNFSWGSEAVTRKTRLLDVVYNASNNELVRTQTLVKSAIVQVDAAPFKQWYLQHYGVEIGRKKKAAAAAKKETEEGETTEETKKSNHVARKLEKRQQTRTLDSHIEEQFGGGRLLACISSRPGQCGRADGYILEGKELEFYMKKIQKKKGKSAA

SEQ ID NO: 13731 - protein, 220 aa, Actinidia deliciosa
MGISRDSMHKRRATGGKKKAWRKKRKYELGRQPANTKLSSNKTVRRVRVRGGNVKWRALRLDTGNFSWGSEAVTRKTRILDVVYNASNNELVRTQTLVKSAIIQVDAAPFKQWYLQHYGVDIGRKKKTTAAAAAKKEGEEGDAATEEAKKSNHVMRKLQKRQQERKLDTHVEEQFGGGRLLAAISSRPGQCGRADGYILEGKELEFYMKKIQRKKGKGAA

SEQ ID NO: 13732 - protein, 135 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKILLLPRRM

SEQ ID NO: 13733 - protein, 164 aa, Cicer arietinum
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFKQWYLQHYGVEIGRKKKSAAAKKDSVGRLKPPLKKPRKVIMCRGNLRTVKKIVS

SEQ ID NO: 13734 - protein, 113 aa, Fraxinus spp
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQW

SEQ ID NO: 13735 - protein, 261 aa, Secale cereale
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAAEGQEAEVAAAATEEAKRATMSRGSLRSVSRDAHWTLTLRSSSAVEGCWPAFHLALDSVAELMGTILEGKELEFYMRKLQKKKGQGCHSLGGRAAACYSYFLSCCVHVMFADILNTIFCKRFES

SEQ ID NO: 13736 - protein, 222 aa, Eucalyptus grandis
MGISRDSMHKRRATGGKKKAWRKKRKYELGRQPANTKLSSNKTVRRIRVRGGNVKWRALRLDTGNYSWGSEAVTRKTRILDVVYNSSNNELVRTQTLVKSAIVQVDAAPFKQWYLQHYGVDIGRKKKAAAAKKEATEEGEAAPAEEAKKSAHVLRKLEKRQKDRQLDAHIEEQFGSGRLLACISSRPGQCGRSDGYILEGKELEFYMKKIQRKKGKAGAGAA

SEQ ID NO: 13737 - protein, 221 aa, Unknown
  Sequence found in Organisms: Solanum tuberosum, Solanum phureja
MGISRDSMHKRRATGGKKKAWRKKRKYEMGRQSANTKLVPNAKTVRRIRVRGGNVKWRALRLDTGNYSWGSEAVTRKTRLLDVVYNASNNELVRTQTLVKSAIVQVDAAPFKQWYLQHYGVEIGRKKKSAAKKEGEEAAEAAAEEKKSNHVQRKLEKRQQDRKIDPHVEEQFASGRLLAAISSRPGQCGRADGYILEGKELEFYMKKLQKKKGKGASGATA

SEQ ID NO: 13738 - protein, 221 aa, Solanum lycopersicum
MGISRDSMHKRRATGGKKKAWRKKRKYEMGRQSANTKLVPNAKTVRRIRVRGGNVKWRALRLDTGNYSWGSEAVTRKTRLLDVVYNASNNELVRTQTLVKSAIVQVDAAPFKQWYLQHYGVEIGRKKKSAAKKEGEEVAEAAAEEKKSNHVQRKLEKRQQDRKIDAHIEEQFASGRLLAAISSRPGQCGRADGYILEGKELEFYMKKLQKKKGKGASGATA

SEQ ID NO: 13739 - protein, 221 aa, Solanum lycopersicum
MGISRDSMHKRRATGGKKKAWRKKRKYEMGRQSANTKLVPNAKTVRRIRVRGGNVKWRALRLDTGNYSWGSEAVTRKTRLLDVVYNASNNELVRTQTLVKSAIVQVDAAPFKQWYLQHYGVEIGRKKKSAAKKEGEEVAEAAAEEKKSNHVQRKLEKRQQDRKIDPHIEEQFASGRLLAAISSRPGQCGRADGYILEGKELEFYMKKLQKKKGKGASGATA

SEQ ID NO: 13740 - protein, 220 aa, Solanum lycopersicum
MGISRDSMHKRRATGGKQKTWRKKRKYELGRQPANTKISSNKTVRRIRVRGGNVKWRALRLDTGNYSWGSEAVTRKTRILDVVYNASNNELVRTQTLVKSAIVQVDAAPFKQWYLQHYGIDIGRKKKGAAKKETTTEEGDAAEEAKKSNHVVRKIEKRQKDRTLDSHLEEQFSSGRLYACISSRPGQCGRADGYILEGKELEFYMKKLQKKKGKASGASA

SEQ ID NO: 13741 - protein, 219 aa, Theobroma cacao
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKEATEEGEGVAEETKKSNHVVRKLEKRQKDRKLDAHIEEQFGAGRLLACISSRPGQCGRADGYILEGKELEFYTKKIQRKKGKGAGAA

SEQ ID NO: 13742 - protein, 225 aa, Amorphophallus konjac
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDATPFKQWVLQHYGVDIGRKKKGPAAAAKKEATEGQEGEAAADEAKKSNHVFRKLEKRQQGRKLDSHIEDQFGGGRLFACISSRPGQCGRADGYILEGKELEFYMKKIQKKKGKGGAGAA

SEQ ID NO: 13743 - protein, 220 aa, Manihot esculenta
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTVAKKETSEEGEGAAVEETKKSNHVQRKLEKRQKDRKLDPHIEEQFGGGRLLACISSRPGQCGRADGYILEGKELEFYMKKLQRKKGKGAGAA

SEQ ID NO: 13744 - protein, 223 aa, Citrus clementina
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAVTKKETTEEGESAAAAAEETKKSNHVVRKLEKRQKDRTLDPHIEEQFGAGRLLACISSRPGQCGRADGYILEGKELEFYMKKLQRKKGKGAGAAA

SEQ ID NO: 13745 - protein, 221 aa, Lactuca sativa
MGISRDSMHKRRATGGKQKTWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAATTKKDTEEGEGATEEAKKSNHVQRKIEKRQEERKLDPHVEEQFSSGRLYACISSRPGQCGRADGYILEGKELEFYVKKLQRKKGKSAGAAF

SEQ ID NO: 13746 - protein, 221 aa, Prunus mume
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTAAAKKDTPEEGEATTEEAKKSNHVARKLEKRQQGRTLDAHIEEQFGGGRLLACISSRPGQCGRADGYILEGKELEFYMKKLQRKKGKGAGAAA

SEQ ID NO: 13747 - protein, 221 aa, Thalictrum flavum
MGISRDSMHKRRATGGKKKAWRKKRKYELGRQPANTKLSSNKTVRRIRVRGGNVKWRALRLDTGNFSWGSEAVTRKTRILDVVYNASNNELVRTQTLVKGAIIQVDAAPFKQWYLQHYGQDIGRKKKGAAAAATKGEEGETVAEEAKKSNHVQRKIEKRQEGRTLDAHIEEQFGGGRLLAAISSRPGQCGRADGYILEGKELEFYMKKLQRKKGKGSAGAA

SEQ ID NO: 13748 - protein, 222 aa, Triphysaria pusilla
MGISRDSMHKRRSTGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAAAAKKDGEETEAAAAEEAKKSNHVKRKIEKRQEERKIDAHIEEQFGGGRLLAAISSRPGQCGRADGYILEGKELEFYMKKLQRKKGKGASGV

SEQ ID NO: 13749 - protein, 221 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKTAAAAKKDVEETEAAAAEEAKKSNHVKRKIEKRQEERKIDAHIEEQFGGGRLLAAISSRPGQCGRADGYILEGKELEFYMKKLQRKKGKGAGGA

SEQ ID NO: 13750 - protein, 219 aa, Antirrhinum majus
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYLQHYGVEIGRKKKTAAKKEGEEAEAAATEEVKKSNHVQRKIEKRQQDRKIDAHIEEQFGGGRLLAAIASRPGQCGRCDGYILEGKELEFYMKKLQRKKGKGAGGA

SEQ ID NO: 13751 - protein, 219 aa, Antirrhinum majus
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYLQHYGVEIGRKKKTAAKKEGEEAEATATEEVKKSNHVQRKIEKRQQERKIDAHIEEQFGGGRLLAAISSRPGQCGRCDGYILEGKELEFYMKKLQRKKGKGAGGA

SEQ ID NO: 13752 - protein, 219 aa, Artemisia annua
MGISRDSMHKRRATGGKQKTWRKKRKYELGRQPANTKISSNKTVRRVRVRGGNVKWRALRLDTGNYSWGSEAVTRKTRILDVVYNASNNELVRTQTLVKGAIVQVDAAPFKQWYLQHYGVDLGRKKKAAATKKEGEEGEGTAEEAKKSNHVQRKIEKRQEERKLDAHVEEQFNSGRLYASISSRPGQCGRADGYILEGKELEFYMKKLQRKKGKGAGAA

SEQ ID NO: 13753 - protein, 220 aa, Musa acuminata
MGISRDSMHKRRATGGKKKAWRKKRKYELGRQPANTKLSSNKTVRRVRVRGGNVKWRALRLDSGNYSWGSEAVTRKTRILDVVYNASNNELVRTQTLVKSAIVQVDAAPFRQWYLQHYGVEIGRKKKAPTASKKDAMEEGEAAAEEEKKSNHVTRKLEKRQQGRILDPHIEDQFGAGRLLACISSRPGQCGRSDGYILEGKELEFYTKKLQRKKGKGAAA

SEQ ID NO: 13754 - protein, 222 aa, Eschscholzia californica
MGISRDSMHKRRATGGKKKAWRKKRKYELGRQPANTKLSSNKTVRRVRVRGGNVKWRALRLDTGNYSWGSETVTRKTRILDVVYNASNNELVRTQTLVKSAIVQVDAAPFKQWYLQHYGLDIGRKKKGSSAAAAPKKEGEEGEAVTEEAKKSNHVARKLESRQKDHKLDPHIEEQFSGGRLLAAISSRPGQCGRADGYILEGKELEFYMKKLQKKKGKGAAA

SEQ ID NO: 13755 - protein, 220 aa, Fagopyrum esculentum
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKTTSKKEASGEDGLDGGEEAKKSNHVQRKLEKRQEGRSLDAHIEEQFSSGRLLAAISSRPGQCGRCDGYILEGKELEFYMKKLQKKKGKSAGAA

SEQ ID NO: 13756 - protein, 220 aa, Cucumis melo
MGISRDSMHKRRATGGKKKAWRKKRKYELGRQPANTKLSSDKSIRRIRVRGGNVKWRAFRLDTGNYSWGSEAVTRKTRILDVVYNASNNELVRTQTLVKSAIVQVDAAPFKQWYLQHYGVDIGRKKKTAASTKKDEEGDAAAAEEVKKSNHVQRKLEKRQEGRKLDPHIEEQFSSGRLMACISSRPGQCGRADGYILEGKELEFYMKKLQRKKGKGAGAA

SEQ ID NO: 13757 - protein, 222 aa, Quercus alba
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVDVGRKKKATTKKETTEEGEGAATATEEIKKSNHVQRKIEKRQKDRQLDPHIEEQFGSGRLLACISSRPGQCGRADGYILEGKELEFYMKKLQRKKGKAGTGA

SEQ ID NO: 13758 - protein, 219 aa, Olea europaea
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKAAAKKEGEETETAATEEAKKSNHVKRKIEKRQQDRKLDPHVEEQFGSGRLLAAISSRPGQCGRADGYILEGKELEFYMKKLQRKKGKGAGAA

SEQ ID NO: 13759 - protein, 222 aa, Triphysaria pusilla
MGISRDSMHKRRSTGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAASAKKDGEETEAAAAEEAKKSNHVKRKIEKRQEERKIDAHIEEQFGGGRLLAAISSRPGQCGRADGYILEGKELEFYMKKLQRKKGKGAGGV

SEQ ID NO: 13760 - protein, 139 aa, Panax ginseng
MWCIMASNNELVRTQTLVKSAIVQVDAAPFKQWYLQHYGVDIGRKKKSSAAAKKEGEEGEAATEEAKKSNHLQRKIEKRQEDRKIDAHIEEQFGGGRLLAAISSRPGQCGRSDGYILEGKELEFYMKKLQRKKGKGAAA

SEQ ID NO: 13761 - protein, 221 aa, Festuca arundinacea
MGISRDSMHKRRATGGKMKAWRKKRKYELGRQPANTKLSSNKTVRRVRVRGGNVKWRALRLDTGNYSWGSEAVTRKTRLLDVVYNSSNNELVRTQTLVKNAIVQVDAAPFKQWYLTHYGVDIGRKKKAPAAAKKDATEEGDAAPVEETRKSNNVQRKLEKRQQGRTLDSHVEEQFSSGRLLACISSRPGQCGRADGYILEGKELEFYMRKLQKKKGKGAAA

SEQ ID NO: 13762 - protein, 225 aa, Festuca arundinacea
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTPAAAKKDAAEGQEGEVAPAATEEAKKSNNVQRKLEKRQQGRTLDAHIEEQFSSGRLLACISSRPGQCGRADGYILEGKELEFYTRKLQKKKGKGAAA

SEQ ID NO: 13763 - protein, 226 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAAAAASAAKKEGEEGDVPIEEAKKSTHVLRKIEKRQEDRKIDAHIEEQFGGGRLLAAISSRPGQCGRADGYILEGKELEFYVKKLQRKKGKGAAA

SEQ ID NO: 13764 - protein, 221 aa, Zea mays
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTPAAKKDNAEGQEVEAAAEETKKSNHVTRKLEKRKEGRTLDPHIEEQFGSGRLLACISSRPGQCGRADGYILEGKELEFYMKKLQRKKGKSAVA

SEQ ID NO: 13765 - protein, 221 aa, Cenchrus ciliaris
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKNAIVQVDAAPFKQWYLTHYGLDIGRKKKAPAAKKDGAEGQEAEAAADETKKSNHVKRKLEKRKEGHKLDPHIEEQFGSGRLLACIASRPGQCGRADGYILEGKELEFYMKKLQKKKGKGAAA

SEQ ID NO: 13766 - protein, 221 aa, Cenchrus ciliaris
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKNAIVQVDAAPFKQWYLTHYGVDIGRKKKAPAAKKDTAEGQEGEAAADETKKSNHVKRKLEKRMEGRKLDLHIEEQFSSGRLLACIASRPGQCGRADGYILEGKELEFYMKKLQKKKGKGAAA

SEQ ID NO: 13767 - protein, 221 aa, Setaria italica
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEAVAEETKKSNHVTRKLEKRKVGRQLDPHIEEQFGSGRLLACIASRPGQCGRADGYILEGKELEFYMKKLQKKKGKGAAA

SEQ ID NO: 13768 - protein, 221 aa, Pennisetum glaucum
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDGAEGQEVEAAADETKKSNHVKRKLEKRKDERKLDLHIEEQFGSGRLLACIASRPGQCGRADGYILEGKELEFYMKKLQKKKGKGAAA

SEQ ID NO: 13769 - protein, 218 aa, Mimulus guttatus
MGISRDSMHKRRATGGKMKAWRKKRKYELGRQPANTKLSSNKTVRRVRVRGGNVKWRALRLDTGNFSWGSEAVTRKTRILDVVYNASNNELVRTQTLVKGAIIQVDAAPFKQWYLQHYGVEIGRKKKAAAKKEGEETEAAAAEEVKKSKHVLRKLEKRQEERTIDQHIEEQFGGGRLLAAISSRPGQCGRADGYILEGKELEFYMKKLQKKKGKSAGA

SEQ ID NO: 13770 - protein, 225 aa, Avena sativa
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKAPAAAKKEASEGQEGEVAAVATEEAKKSNNVQRKLEKRQQGRSLDSHIEEQFSGGRLLACISSRPGQCGRADGYILEGKELEFYMRKLQKKKGKGAAA

SEQ ID NO: 13771 - protein, 220 aa, Papaver somniferum
MGISRDSMHKRRATGGKKKAWRKKRKYELGRQPANTKLSSNKTVRRVRVRGGNVKWRALRLDTGNYSWGSETVTRKTRILDVVYNASNNELVRTQTLVKSAIVQVDAAPFKQWYLQHYGLDIGRKKKTAAAKKETTEEGDAAAAEEAKKSNHVIRKIEKRQVDHKLDPHIEEQFSGGRLLACISSRPGQCGRADGYILEGKELEFYMKKLQKKKGKGAAA

SEQ ID NO: 13772 - protein, 220 aa, Sorghum bicolor
MGISRDSMHKRRATGGKQKAWRKKRKYELGRQPANTKLSSNKTVRRVRVRGGNVKWRALRLDTGNYSWGSEALTRKTRILDVVYNASNNELVRTQTLVKSAIVQVDAAPFKQWYLTHYGVDIGRKKVPVAKKDAAEGQEGEAIAEETKKSNHVQRKLEKRQQGRALDTHIEEQFGSGRLLACISSRPGQCGRADGYILEGKELEFYMKKLQRKKGKGAAS

SEQ ID NO: 13773 - protein, 219 aa, Tragopogon dubius
MGISRDSMHKRRATGGKQKTWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKVAATTKKDAEEGEGVTEEAKKSNHVKRKIEKRQEERKLDAHVEEQFGSGRLYACISSRPGQCGRADGYILEGKELEFYMKKLQRKKGKGAAA

SEQ ID NO: 13774 - protein, 68 aa, Cenchrus ciliaris
MEHQRGDQATAATMGISRDSMHKRRATGGKQKAWRKKRKYELGRQPANTKLSSNKTVRRVRVRGGNVK

SEQ ID NO: 13775 - protein, 236 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKGAATAPKKEGEDAEGATEEAKKSNHVVRKLEKRQEERKLDAHVEEQFSGGRLYAAISSRPGQCGRADGYILEGKELEFYMKKLQKRKEKVLLKSCYRFVSSFLLFNLRK

SEQ ID NO: 13776 - protein, 153 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAAAKKERRVMFLSRRRRRVNMS

SEQ ID NO: 13777 - protein, 152 aa, Triphysaria pusilla
MGISRDSMHKRRATGGKQKTWRKKRKYGLGRQPANTKLSSNKTVRRVRVRGGNVKWRALRLDTGNFSWGSEAVTRKTRILDVVYNASNNELVRTQTLVKGAIIQVDAAPFKQWYLQHYGVRLVARKRLLLLPRRMERRLRLLLLKRQRRATM

SEQ ID NO: 13778 - protein, 249 aa, Brassica napus
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAAPEEVKKSNHVQRKIESRQEGRTLDSHIEDQFASGRLLACTLLRRPGPMVDVLSGYYFLGRTKSLSNSYQKKYSRRRKDEGSPYLNSLSVLKVFILFFS

SEQ ID NO: 13779 - protein, 219 aa, Cirsium arvense
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPSATATKKEGEEAEAATEEAKKSNHVVRKLEKRQEERKLDGHVEEQFSGGRLYAAISSRPGQCGRADGYILEGKELEFYMKKLQKKKGKGAA

SEQ ID NO: 13780 - protein, 220 aa, Solanum melongena
MGISRDSMHKRRATGGKKKAWRKKRKYELGRQPANTKISSNKTVRRIRVRGGNVKWRALRLDTGNYSWGSEAVTRKTRILDVVYNASNNELVRTQTLVKSAIVQVDAAPFKQWYLQHYGVDIGRKKKGASKKESTTEEGEATEEAKKSNHVVRKIEKRQKDRTLDSHLEEQFGSGRLYACISSRPGQCGRADGYILEGKELEFYMKKLQKKKGKASGAAA

SEQ ID NO: 13781 - protein, 217 aa, Flaveria ramosissima
ISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKGASAATKKEGEEAETTTEEAKKSNHVVRKLEKRQEDRKLDPHVEEQFSSGRLLAAISSRPGQCGRADGYILEGKELEFYMKKLQKKKGKGAA

SEQ ID NO: 13782 - protein, 217 aa, Papaver somniferum
MGISRDSMHKRRATGGKKKAWRKKRKYELGRQPANTKLSSNKTVRRVRVRGGNVKWRALRLDTGNYSWGSETVTRKSRILDVVYNASNNELVRTQTLVKGAIVQVDAAPFKQWYLQHYGLDIGRKKKITSAKKEGEEAEAVAEEAKKSNHLLRKIESRQQDHKLDSHIEEQFSGGRLLACISSRPGQCGRADGYILEGKELEFYQKKLQKKKGKGAA

SEQ ID NO: 13783 - protein, 219 aa, Carthamus tinctorius
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKGAATVAKKEGEEAEGATEEAKKSNHVVRKLEKRQEERKLDAHVEEQFSGGRLYAAISSRPGQCGRADGYILEGKELEFYMKKLQKKKGKGAA

SEQ ID NO: 13784 - protein, 219 aa, Carthamus tinctorius
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPSATATKKEGEEAEAATEEAKKSNHVVRKLEKRQEERKLDAHVEEQFSGGRLYAAISSRPGQCGRADGYILEGKELEFYMKKLQKKKGKGAA

SEQ ID NO: 13785 - protein, 219 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPSATATKKEGEEAEAAAEEAKKSNHVVRKLEKRQEERKLDAHVEEQFSGGRLYAAISSRPGQCGRADGYILEGKELEFYMKKLQKKKGKGAA

SEQ ID NO: 13786 - protein, 221 aa, Catharanthus roseus
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKAAAVKKDATEEGEATVEETKKSNHVQRKLEKRQQGRTLDAHIEEQFGAGRLLACISSRPGQCGRADGYILEGKELEFYMKKLQRKKGKGAGAAA

SEQ ID NO: 13787 - protein, 220 aa, Solanum melongena
MGISRDSMHKRRATGGKKKAWRKKRKYELGRQPANTKLVPNAKTVRRIRVRGGNVKWRALRLDTGNYSWGSEAVTRKTRLLDVVYNASNNELVRTQTLVKSAIVQVDAAPFKQWYLQHYGVEIGRKKKTAASKKEGEEAEAAPEEKKSNHVQRKLEKRHQDRKIDPHVEEQFASGRLLAAISSRPGQCGRADGYILEGKELEFYMKKLQKKKGKGASGAA

SEQ ID NO: 13788 - protein, 221 aa, Nicotiana tabacum
MGISRDSMHKRRATGGKKKAWRKKRKYELGRQPANTKLVTNAKTVRRIRVRGGNVKWRALRLDTGNFSWGSEAVTRKTRLLDVVYNASNNELVRTQTLVKSAIVQVDAAPFKQWYLQHYGVDIGRKKKSAAKKEGEEAETAPAAEEKKSNHVQRKLQKRQQDRKIDPHVEEQFASGRLLAAISSRPGQCGRADGYILEGKELEFYMKKLQKKKGKGASGAA

SEQ ID NO: 13789 - protein, 222 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPTAAAAVKKEGEEAEVAAEETKKSNHVVRKLEKRQEERKLDQHVEEQFSGGRLYAAISSRPGQCGRADGYILEGKELEFYMKKLQKKKGKSGGAA

SEQ ID NO: 13790 - protein, 222 aa, Unknown
  Sequence found in Organisms: Centaurea maculosa, Cirsium arvense
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPTAAAAIKKEGEEAEVAAEETKKSNHVVRKLEKRQEERKLDQHVEEQFSGGRLYAAISSRPGQCGRADGYILEGKELEFYMKKLQKKKGKSGGAA

SEQ ID NO: 13791 - protein, 222 aa, Triphysaria pusilla
MGISRDSMHKRRSTGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTTAAAAKKDGEETEAAAAEEAKKSNHVKRKIEKRQEERKIDAHIEEQFGGGRLLAAISSRPGQCGRADGYILEGKELEFYMKKLQRKKGKGAGGV

SEQ ID NO: 13792 - protein, 223 aa, Amorphophallus konjac
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKQQPSAASAKKEGEEGDGAAEDTKKSNHVVRKIEKRQQGRKLEPHIEEQFGSGRLLAAISSRPGQCGRGDGYILEGKELEFYMKKIQRKKGKGAGAA

SEQ ID NO: 13793 - protein, 210 aa, Arabidopsis thaliana
MGISRDSIHKRRATGGKQKMWRKKRKYELGRQPANTKLSSNKTVRRIRVRGGNVKWRALRLDTGNFSWGSEAVTRKTRILDVAYNASNNELVRTQTLVKSAIVQVDAAPFKQGYLQHYGVDIGRKKKGEAVTTEEVKKSNHVQRKLEMRQEGRALDSHLEEQFSSGRLLACIASRPGQCGRADGYILEGKELEFYMKKLQKKKGKNAGAA

SEQ ID NO: 13794 - protein, 221 aa, Musa acuminata
MGISRDSMHKRRATGGKKKAWRKKRKYELGRQPASTKLSSNKTVRRIRVRGGNVKWRALRLDHGNYSWGSEAVTRKTRILDVVYNASNNELVRTQTLVKSAIIQVDAAPFKQWYLQHYGVEIGRKKKAPSAKKEATEEGEAATEEEKKSNHVTRKLEKRQQGRKLDPHIEEQFGSGRLLASISSRPGQCGRADGYILEGKELEFYMKKIQRKKGKGAGAAA

SEQ ID NO: 13795 - protein, 221 aa, Ricinus communis
MGISRDSMHKRRATGGKKKAWRKKRKYELGRQAANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTVAKKETEEGEGEGAAAEESKKSNHVIRKLEKRQKDRKLDAHIEEQFWGGRLLACISSRPGQCGRADGYILEGKELEFYMKKLQRKKGKGAGAA

SEQ ID NO: 13796 - protein, 222 aa, Centaurea maculosa
  misc_feature (134)..(134): Xaa can be any naturally occurring amino acid
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPTAAAAXKKEGEEAEVAAEETKKSNHVVRKLEKRQEERKLDQHVEEQFSGGRLYAAISSRPGQCGRADGYILEGKELEFYMKKLQKKKGKSGGAA

SEQ ID NO: 13797 - protein, 217 aa, Cichorium intybus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAKKEGEEAEGATEETKKSNHVVRKIEKRQEERKLDQHVEEQFSSGRLLAAISSRPGQCGRADGYILEGKELEFYMKKLQKKKGKSAGTA

SEQ ID NO: 13798 - protein, 220 aa, Coffea canephora
MGISRDSMHKRRATGGKKKAWRKKRKYELGRQPANTKLSSNKTVRRVRVRGGNVKWRALRLDTGNYSWGSEAVTRKTRILDVMYNASNNELVRTQTLVKSAIVQVDAAPFKQWYLQHYGVDIGRKKKGPAKKDTTEDGEATAEETKKSNHVVRKLEKRQQGRTLDPHIEEQFGGGRLLACISSRPGQCGRADGYILEGKELEFYMKKIQRKKGKASGGAA

SEQ ID NO: 13799 - protein, 221 aa, Unknown
  Sequence found in Organisms: Taraxacum officinale, Helianthus annuus
MGISRDSMHKRRATGGKQKTWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAAATTKKDTEEGEGTTEEAKKSNHVQRKIEKRQEERKLDAHVEEQFSSGRLYACISSRPGQCGRADGYILEGKELEFYVKKLQRKKGKSAGAAF

SEQ ID NO: 13800 - protein, 220 aa, Gerbera hybrid cultivar
MGISRDSMHKRRATGGKQKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKAVAAAKKEGEEVEGATEEAKKSNHVARKLQKRQEDRKLDPHVEEQFSSGRLLAAISSRPGQCGRADGYILEGKELEFYMKKLQKKKGKSAGTA

SEQ ID NO: 13801 - protein, 223 aa, Ipomoea nil
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSAAAKKETNEEGEGATAPEETKKSNHVVRKIEKRQKDRKLDSHLEEQFGSGRLMACIASRPGQCGRADGYILEGKELEFYMKKIQRKKGKGSGATA

SEQ ID NO: 13802 - protein, 224 aa, Elaeis guineensis
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIIQVDAAPFKQWYLQHYGVEIGRKKKAPAATKKEATEGQEGEGATEEPKKSNHVLRKLEKRQQGRKLDPHIEEQFGSGRLLACISSRPGQCGRADGYILEGKELEFYMKKIQRKKGKGGAGAA

SEQ ID NO: 13803 - protein, 222 aa, Carthamus tinctorius
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPTAAAAIKKEGEEAEVAAEEAKKSNHVVRKLEKRQEERKLDQHVEEQFSGGRLYAAISSRPGQCGRADGYILEGKELEFYMKKLQKKKGKSGGAA

SEQ ID NO: 13804 - protein, 219 aa, Citrullus lanatus
MGISRDSMHKRRATGGKKKAWRKKRKYELGRQPANTKLSSDKSIRRIRVRGGNVKWRAFRLDTGNYSWGSEAVTRKTRILDVVYNASNNELVRTQTLVKSAIVQVDAAPFKQWYLQHYGVDIGRKKKTSASAKKEEEGDAATEEVKKSNHVQRKIEKRQQDRKLDPHIEEQFSSGRLMACISSRPGQCGRADGYILEGKELEFYMKKLQRKKGKGAGAA

SEQ ID NO: 13805 - protein, 225 aa, Unknown
  Sequence found in Organisms: Festuca arundinacea, Lolium multiflorum
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTTAAAKKDAAEGQEGEVAAAATEEAKKSNNVQRKLEKRQQGRTLDAHIEEQFSGGRLLACISSRPGQCGRADGYILEGKELEFYMRKLQKKKGKGASA

SEQ ID NO: 13806 - protein, 219 aa, Panax ginseng
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQWYLQHYGVDIGRKKKTSASAKKEGEDADTPTEEAKKSNHVLRKIEKRQEDRKIDAHIEEQFGGGRLLAAISSRPGQCGRADGYILEGKELEFYMKKLQRKKGKGATA

SEQ ID NO: 13807 - protein, 218 aa, Artemisia annua
MGISRDSMHKRRATGGKKKAWRKKRKYELGRQSANTKISSNKTVRRVRVRGGNVKWRALRLDTGNYSWGSEAVTRKTRILDVVYNASNNELVRTQTLVKSAIVQVDAAPFKQWYLQHYGVDLGRKKKAVASATKKEGEEVETEEAKKSNHVVRKLEKRLEERKLDPHVEEQFSGGRLLAAISSRPGQCGRADGYILEGKELEFYMKKLQKKKGKGAAA

SEQ ID NO: 13808 - protein, 216 aa, Physcomitrella patens
MGISRDSTHKRRATGGKKKSWRKKRKYELGRQGAMTKLSSNKTVRRIRVRGGNSKFRALRLDTGNYSWGSEAVTRKTRVLDVVYNASNNELVRTQTLVKNAIVQVDAAPFRTWYSQHYGVEIGKKKKSAAKKDSEDAEATEEEKKSNHVQKKLAKRVEGHKLDSHLEDQFASGRLLACIASRPGQCGRADGYILEGKELEFYQKKIQKKKGKGAAA

SEQ ID NO: 13809 - protein, 219 aa, Centaurea maculosa
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDAAPFKQWYLQHYGVDIGRKKKPSATATKKEGEEAEAAAEEAKKSNHIVRKLEKRQEERKLDAHVEEQFSGGRLYAAISSRPGQCGRADGYILEGKELEFYMKKLQKKKGKGAA

SEQ ID NO: 13810 - protein, 206 aa, Acacia harpophylla
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDVGRKKKTATSAKKEGEDGEAATEEVKKSKHVLRKLEKRQQNRTLDSHIEEQFGGGRLLACISSRPGQCGRADGYILEGKELEFYM

SEQ ID NO: 13811 - protein, 217 aa, Guizotia abyssinica
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTAPSATKKEGEEAEGATEEAKKSNHVVRKLEKRQEERKLDPHVEEQFSSGRLLAAISSRPGQCGRADGYILEGKELEFYMKKLQKKKGRV

SEQ ID NO: 13812 - protein, 97 aa, Ipomoea nil
MGISRDSMHKRRATGGKQKAWRKKRKYELGRQPANTKLSSNKTVRRIRVRGGNVKWRALRLDTGNYSWGSEAVTRKTRVLDVVYNASNNELVRHKLW

SEQ ID NO: 13813 - protein, 193 aa, Pennisetum glaucum
MGISRDSMHKRRATGGKQKAWRKKRKYELGRQPANTKLSSNKTVRRVRVRGGNVKWRALRLDTGNYSWGSEAVTRQTRILDVVYNASNNELVRTQTLVKSAIVQVDAAPFKQWYLTHYGVDIGRKKKAPAAKKDGAEGQEVEAAADETKKSNHVKRKLEKRKDERKLDLHIEEQFGSGRLLACIASAWAVWPG

SEQ ID NO: 13814 - protein, 223 aa, Nicotiana benthamiana
MGISRDSMHKRRATGGKKKSWRKKRKYELGRQPANTKISGNKTVRRIRVRGGNVKWRALRLDTGNYSWGSEATTRKTRILDVVYNASNNELVRTQTLVKSAIVQVDAAPFKQWYLQHYGVDIGRKKKGAAKKETTEEGEAAAPAEEAKKSNHVARKLEKRQKDRKLDPHLEEQFGSGRLYACISSRPGQCGRADGYILEGKELEFYMKKLQKKKGKAGSGAAA

SEQ ID NO: 13815 - protein, 224 aa, Nicotiana benthamiana
MGISRDSMHKRRATGGKKKAWRKKRKYELGRQPANTKISANKTVRRIRVRGGNVKWRALRLDTGNYSWGSEAVTRKTRILDVVYNASNNELVRTQTLVKSAIVQVDAAPFKQWYLQHYGVDIGRKKKGPAKKETTEEGEGAAAAAEETKKSNHVLRKIETRQKDRKLDPHIEEQFGGGRLLACISSRPGQCGRADGYILEGKELEFYMKKLQKKKGKAGAGGTA

SEQ ID NO: 13816 - protein, 223 aa, Elaeis guineensis
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIIQVDAAPFKQWYLQHYGVEIGRKKKAPAASKKEATEEGEGATEEAKKSNHVLRKLEKRQQCRTLDPHIEEQFGSGRLLACISSRPGQCGRADGYILEGKELEFYMKKIQRKKGKGGSGAAA

SEQ ID NO: 13817 - protein, 112 aa, Sarracenia psittacina
MGISRDSMHKRRATGGKKKAWRKKRKYELGRQPANTKLSSNKTVRRVRVRGGNVKWGALRLDTGNYSWGSEAVTRKTRILDVVYNASNNELVRTQTLVKSAIVQVDAAPFKQ

SEQ ID NO: 13818 - protein, 224 aa, Nicotiana tabacum
MGISRDSMHKRRATGGKKKAWRKKRKYELGRQPANTKISTNKTVRRIRVRGGNVKWRALRLDTGNYSWGSEAVTRKTRILDVVYNASNNELVRTQTLVKSAIVQVDAAPFKQWYLQHYGVDIGRKKKGPAKKETTEEGEGAAAAAEETKKSNHVLRKIETRQKDRKLDPHIEEQFGGGRLLACISSRPGQCGRADGYILEGKELEFYMKKLQKKKGKAGAGGAA

SEQ ID NO: 13819 - protein, 221 aa, Nicotiana benthamiana
MGISRDSMHKRRATGGKKKAWRKKRKYELGRQPANTKLVPNAKTVRRIRVRGGNVKWRALRLDTGNFSWGSEAVTRKTRLLDVVYNASNNELVRTQTLVKSAIVQVDAAPFKQWYLQHYGVDIGRKKKSAVKKEGEEAETAPAAEEKKSNHVQRKLQKRQQDRKIDPHVEEQFASGRLLAAISSRPGQCGRADGYILEGKELEFYMKKLQKKKGKGASGAA

SEQ ID NO: 13820 - protein, 220 aa, Capsicum annuum
MGISRDSMHKRRATGGKQKAWRKKRKYELGRQPANTKLVPNAKTVRRIRVRGGNVKWRALRLDTGNYSWGGEAVTRKTRLLDVVYNASNNELVRTQSLVKSAIVQVDAAPFKQWYLQHYGVEIGRKKKAAASKKEGEEAEAVPEEKKSNHVQRKLEKRQQDRKIDPHVEEQFASGRLLAAISSRPGQCGRADGYILEGKELEFYMKKLQKKKGKGAGGAA

SEQ ID NO: 13821 - protein, 221 aa, Solanum lycopersicum
MGISRDSMHKRRATGGKQKTWRKKRKYELGRQPANTKLVPNAKTVRRIRVRGGNVKWRALRLDTGNFSWGSEAVTRKTRLLDVVYNASNNELVRTQTLVKSAIIQVDAAPFKQWYLQHYGVEIGRKKKTAASSKKEGEEAEAVAEEKKSNHVQRKLEKRQQDRKIDPHVEEQFASGRLLAAISSRPGQCGRADGYILEGKELEFYMKKLQKKKGKGAGAAA

SEQ ID NO: 13822 - protein, 223 aa, Musa acuminata
MGISRDSMHKRRATGGKKKAWRKKRKYELGRQPANTKLSSNKTVRRVRVRGGNVKWRALRLDHGNYSWGSEAVTRKTRILDVVYNASNNELVRTQTLVKSAIIQVDAAPFKQWYLQHYGVEIGRKKKAPAVKKEATEGQEAEPATEEANKSNHVTRKLEKRQQGRKLDAHIEEQFSSGRLLACISSRPGQCGRADGYVLEGKELEFYMKKIQRKKGKGAGGAA

SEQ ID NO: 13823 - protein, 225 aa, Fagus grandifolia
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYHQHYGVDIGRKKKTVAKKDTPEEGGKPEAEAATEETKKSNHVLRKIEKRQQGRSLDAHIEEQFGGGRLLACISSRPGQCGRADGYILEGKELEFYMKKLQRKKGKGAGAAA

SEQ ID NO: 13824 - protein, 223 aa, Eschscholzia californica
MGISRDSMHKRRATGGKKKAWRKKRKYELGRQPANTKLSSNKTVRRVRVRGGNVKWRALRLDTGNYSWGSETVTRKTRILDVVYNASNNELVRTQTLVKSAIVQVDAAPFKQWYLQHYGVEIGRKKKSTTKKETAEGQEGDAAAVEETKKSNHVMRKIEKRQQDHKLDAHIEEQFSGGRLLACISSRPGQCGRADGYILEGKELEFYMKKLQKKKGKGSAGAA

SEQ ID NO: 13825 - protein, 222 aa, Ipomoea batatas
MGISRDSMHKRRATGGKQKAWRKKRKYELGRQSANTKLSSNKTVRRIRVRGGNVKWRALRLDTGNYSWGSEAVTRKTRILDVVYNASNNELVRTQTLVKSAIVQVDAAPFKQWYLQHYGVDIGRKKKGPAKKETAEEGNEGAAVEETKKSNHVQRKLEKRQKDRKLDSHLEEQFGSGRLMACISSRPGQCGRADGYILEGKELEFYMKKIQRKKGKGAGAAA

SEQ ID NO: 13826 - protein, 223 aa, Ipomoea batatas
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQWYLQHYGVDIGRKKKSAAAKKETNEEGEGATAPEETKKSNHVLRKIEKRQKDRKLDSHLEEQFSSGRLMACIASRPGQCGRADGYILEGKELEFYMKKIQRKKGKGSGAAA

SEQ ID NO: 13827 - protein, 220 aa, Ipomoea nil
GISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAKKETAEETEGVAAEETKKSNHVQRKLEKRQKERKLDSHLEEQFGSGRLMACISSRPGQCGRADGYILEGKELEFYMKKIQRKKGKGSGAAA

SEQ ID NO: 13828 - protein, 221 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAAKKDAEETEAAAVAEEAKKSNHVKRKIEKRQEERKIDAHIEEQFGGGRLLAAISSRPGQCGRADGYILEGKELEFYMKKLQRKKGKGASGV

SEQ ID NO: 13829 - protein, 220 aa, Triphysaria pusilla
MGISRDSMHKRRATGGKQKTWRKKRKYELGRQPANTKLSSNKTVRRVRVRGGNVKWRALRLDTGNFSWGSEAVTRKTRILDVVYNASNNELVRTQTLVKGAVIQVDAAPFKQWYLQHYGVEIGRKKKTAAAAKKDVEETEAAAEEAKKSNHVKRKIEKRQEERKIDAHIEEQFGGGRLLAAISSRPGQCGRADGYILEGKELEFYMKKLQRKKGKGASGV

SEQ ID NO: 13830 - protein, 221 aa, Cucurbita pepo
MGISRDSMHKRRATGGKKKAWRKKRKYELGRQPANTKISSDKSIRRIRVRGGNVKWRAFRLDTGNYSWGSEAVTRKSRILDVVYNASNNELVRTQTLVKSAIVQVDAAPFKQWYLQHYGVDIGRKKKTSAPAKKEEEGEAAAAAEELKKSNHVQRKLEKRQQDRKLDPHIEEQFSSGRLMACISSRPGQCGRADGYILEGKELEFYMKKLQRKKGKGAGAA

SEQ ID NO: 13831 - protein, 222 aa, Zingiber officinale
  misc_feature (27)..(27): Xaa can be any naturally occurring amino acid
  misc_feature (37)..(37): Xaa can be any naturally occurring amino acid
MGISRDSMHKRRATGGKKKAWRKKRKXELGRQPANTXLSSNKTVRRVRVRGGNVKWRALRLDTGNYSWGSEAVTRKTRILDVVYNASNNELVRTQTLVKSAIVQVDAAPFKAWYLQHYGVELGKKKKSASATKKETTEGQEGEPTAEVKKSSHVLRKLEKRQQDRKLDSHIEDQFGTGRLLAAISSRPGQCGRADGYILEGKELEFYMKKIQKKKGKGAGAA

SEQ ID NO: 13832 - protein, 221 aa, Lactuca sativa
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTPASGNKKEGEEAEGATEETKKSNHVVRKIEKRQEERKLEQHVEEQFSSGRLLAAISSRPGQCGRADGYILEGKELEFYMKKLQKKKGKSGATA

SEQ ID NO: 13833 - protein, 215 aa, Musa acuminata
MHKRRATGGKKKAWRKKRKYELGRQPANTKLSSNKTVRRVRVRGGNVKWRALRLDSGNYSWGSEAVTRKTRVLDVVYNASNNELVRTQTLVKSAIVQVDAAPFKQWYFQHYGIEIGRKKKAPTASKKEAAEEGEAAVEEGKKSNHVTRKLEKRQQGCKLDPHIEEQFGAGRLLACISSRPGQCGRADGYILEGRELEFYMKKIQRKKGKGTGAAA

SEQ ID NO: 13834 - protein, 219 aa, Panax ginseng
MGISRDSMHKRRATGGKKKAWRKKRKYELGRQPASTKLSSNKTVRRLRVRGGNVKWRALRLDTGNYSWGSEAVTRKTRILDVVYNASNNELVRTQTLVKSAIVQVDAAPFKQWYLQHYGVDIGRKKKTSASAKKEGEDADTPTEEAKKSNHILRKIEKRQEDRKIDAHIEEQFGGGRLLAAISSRPGQCGRADGYILEGKELEFYMKKLQRKKGKGATA

SEQ ID NO: 13835 - protein, 219 aa, Vitis vinifera
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIIQVDAAPFKQWYLQHYGLDIGRKKKASATAKKEGEEGDGPAEETKKSNHVVRKLEKRQQEHKLDPHIEEQFGSGRLLAAISSRPGQCGRADGYILEGKELEFYMKKIQRKKGKGSAA

SEQ ID NO: 13836 - protein, 221 aa, Zea mays
MGISRDSMHKRRATGGKQKAWRKKRKYELGRQPANTKLSSNKTVRRVRVRGGNVKWRALRLDTGNYSWGSEALTRKTRILDVVYNASNNELVRTQTLVKSAIVQVDAAPFKQWYLTHYGVDIGRKKKVPVAKKDATEGQEGEAIAEETKKSNHVQRKIEKRQQDRALDTHIEEQFGSGRLLACISARPGQCGRADGYILEGKELEFYMKKLQRKKGKGVAS

SEQ ID NO: 13837 - protein, 225 aa, Lolium multiflorum
MGISRDSMHKRRATGGKMKAWRKKRKYELGRQPANTKLSSNKTVRRVRVRGGNVKWRALRLDTGNFSWGSEAVTRKTRLLDVVYNASNNELVRTQTLVKNAIVQVDAAPFKGWYLTHYGVDIGRKKKTTAAAKKDAAEGQEGEVAATATEEAKKSNNVQRKLEKRQQGRTLDAHIEEQFSGGRLLACISSRPGQCGRADGYILEGKELEFYMRKLQKKKGKGASA

SEQ ID NO: 13838 - protein, 217 aa, Arnica chamissonis
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKTASKKEAEEAEGATEETKKSNHVVRKLEKRQEERKLDQHVEEQFSSGRLLAAISSRPGQCGRADGYILEGKELEFYMKKLQKKKGKSAAA

SEQ ID NO: 13839 - protein, 217 aa, Artemisia annua
MGISRDSMHKRRATGGKKKAWRKKRKYELGRQAANTKISSNKTVRRVRVRGGNVKWRALRLDTGNYSWGSEAVTRKTRILDVVYNSSNNELVRTQTLVKSAIVQVDAAPFKQWYLQHYGVDLGRKKKAAAKKEGEEAEGATEETKKSNHVVRKIEKRQEERKLDQHVEEQFSGGRLLAAISSRPGQCGRADGYILEGKELEFYMKKLQKKKGKSAAA

SEQ ID NO: 13840 - protein, 213 aa, Bruguiera gymnorhiza
MGISRDSMHKRRATGGKKKAWRKKRKYELGRQPASTKLSSNKTVRRIRVRGGNLKWRALRLDTGNYSWGSEAVTRKTRILDVVYNASNNELVRTQTLVKSAIIQVDASPFKQWYLQHYGVDIGRKKKTAVATKKEGEEGEAATEEVKKSNHVLRKLEKRQQNRQLDPHIEEQFGGGRLLACISSRPGQCGRADGYILEGKELEFYMKKIQRKK

SEQ ID NO: 13841 - protein, 218 aa, Salvia sclarea
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYLQHYGVEIGRKKKAAAKKEGEETTEAATEEVKKSNHVQRKLEKRQQDRKIDTHIEEQFGGGRLLAAISSRPGQCGRCDGYILEGKESEFYMKKLQRKKGKGASA

SEQ ID NO: 13842 - protein, 215 aa, Senecio madagascariensis
MGISRDSMHKRRATGGKKKAWRKKRKYELGRQPANTKISSNKTVRRVRVRGGNVKWRALRLDTGNFSWGSEAVTRKTRILDVVYNASNNELVRTQTLVKSAIVQVDVAPFKQWYLQHYGVDIGRKKKTAAKKEGEEAEATEETKKSNNVVRKLAKRQEERTLDEHVEEQFSSGRLLAAISSRPGQCGRADGYILEGKELEFYMKKLQKKKGKSAA

SEQ ID NO: 13843 - protein, 152 aa, Panax ginseng
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYSVDIGRKKKTSASAKKKERMVTLLPRRQRRATMS

SEQ ID NO: 13844 - protein, 160 aa, Panax ginseng
RDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKSSAAAAKKEGEEGDVPIEEAKKSKHVLRKIRKASRGS

SEQ ID NO: 13845 - protein, 222 aa, Arachis hypogaea
MHKRRATGGKKKVWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKGATSGKKEGEDAETATEEVKKSNHVLRKLEKRKQTRVLDSHIEEQFGSGRLLASISSRPGQCGRADGYILEGKELEFYMKKLQKKRARVLLKMLYFLHFSFL

SEQ ID NO: 13846 - protein, 225 aa, Persea americana
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGIDIGRKKKAPASKKEAVEGQEGDAAASEQAKKSNHVIRKLEKRQQGHKLDPHIEEQFSGGRLLAAISSRPGQCGRADGYILEGKELEFYMKKIQRKKGKSGAGAAA

SEQ ID NO: 13847 - protein, 222 aa, Vaccinium corymbosum
MGISRDSMHKRRATGGKKKAWRKKRKYELGRQPANTKLSSNKTVRRVRVRGGNVKWRALRLDTGNYSWGSEAVTRKTRMLDVVYNASNNELVRTQTLVKGAIIQVDAAPFKQWYLQHYGVDIGRKKKGPIKKEAAEEGEGVAAEEAKKSNHVVRKIEKRQQGRKLDPHIEEQFGGGRLLACISSRPGQCGRADGYILEGKELEFYMKKLQRKKGKGAAGAAA

SEQ ID NO: 13848 - protein, 205 aa, Mimulus guttatus
MGISRDSMHKRRETGGKKKAWRKKRKYELGRQPANTKLSSNKTVRRVRVRGGNVKWRALRLDTGNFSWGSEAVTRKTRILDVVYNASNNELVRTKTLVKSAIIQVDAAPFKQWYLQHYGVDISRKKKAAVKKEGEEAEAAATEEAKKSNHVHRKIEKRQEERKINTHIEEQFCSGRLLALPFLHAQASAVALTVIFWTGRSWSFT

SEQ ID NO: 13849 - protein, 222 aa, Solanum lycopersicum
MGISRDSMHKRRATGGKKKAWRKKRKYELGRQPANTKLSNNKTVRRIRVRGGNVKWRALRLDTGNYSWGSEAVTRKTRILDVVYNASNNELVRTQTLVKSAIIQVDAAPFKQWYLQHYGADIGRKKKGPAKKDTTEEGEAAAAEETKKSNHVQRKIENRQKDRTLDPHLEEQFGGGRLLACISSRPGQCGRCDGYILEGKELEFYMKKLQKKKGKSGAGAAA

SEQ ID NO: 13850 - protein, 212 aa, Citrullus lanatus
MHKRRATGGKKKAWRKKRKYELGRQPANTKLSSDKSIRRIRVRGGNVKWRAFRLDTGNYSWGSEAVTRKTRILDVVYNASNNELVRTQTLVKSAIVQVDAAPFKQWYLQHYGVDIGRKKKTSASAKKEEEGDAPSEEVKKSNHVQRKLEKRQQDRKLDPHIEEQFSSGRLMACISSRPGQCGRADGYILEGKELEFYMKKLQRKKGKGAGAA

SEQ ID NO: 13851 - protein, 147 aa, Zostera marina
MGISRDSMHKRRATGGKKKAWRKKRKYELGRQAANTKLSSNKTVRRVRVRGGNVKWRALRLDTGNFSWGSEAVTRKTRLLDVVYNASNNELVRTQTLVKNAIVQVDAAPFKQWYLQHYGVDVGRKKKVTAVKKDTEGVEAVVEEAKK

SEQ ID NO: 13852 - protein, 220 aa, Aquilegia formosa
MGISRDSMHKRRATGGKKKAWRKKRKYELGRQPANTKLSSNKTVRRIRVRGGNVKWRALRLDTGNYSWGSEAVTRKTRVLDVVYNASNNELVRTQTLVKSAIVQVDAAPFRQWYSQHYGVDIGRKKKSTAKKEATEEGDAPAEETKKSNHVLRKIGDRQKDHKLDAHIEEQFGGGRLLACISSRPGQCGRADGYILEGKELEFYTKKLQRKKGKGAGATA

SEQ ID NO: 13853 - protein, 223 aa, Vaccinium corymbosum
MGISRDSMHKRRATGGKKKAWRKKRKYELGRQPANTKLCKDAKTVKTVRRIRVRGGNVKWRALRLDTGNYSWGSEAVTRKTRILDVVYNASNNELVRTQSLVKSAIVQVDAAPFKQWYLQHYGVDIGRKKKSSSAKKEGEEADAAPAEEVKKSNHVVRKVEKRQQDRKIDPHVEEQFGGGRLLAAISSRPGQCGRADGYILEGKELEFYMKKIQKKKGKGAAA

SEQ ID NO: 13854 - protein, 222 aa, Platanus occidentalis
MGISRDSMHKRRATGGKKKAWRKKRKYELGRQPANTKLSSNKTVRRVRVRGGNVKWRALRLDTGNYSWGSEAVTRKTRLLDVVYNASNNELVRTQTLVKSAIVQVDAAPFKQWYLQHYGVDIGRKKKAVAAKKETTEEGEGTTAEEKKKSNHVARKIEKRLQGHKLDPHIEEQFGGGRLLACISSRPGQCGRADGYILEGKELEFYTRKLQRKKGKGAAGTA

SEQ ID NO: 13855 - protein, 224 aa, Solanum tuberosum
MGISRDSMHKRRATGGKKKAWRKKRKYELGRQPANTKLSNNKTVRRIRVRGGNVKWRALRLDTGNYSWGSEAVTRKTRILDVVYNASNNELVRTQTLVKSAIIQVDAAPFKQWYLQHYGADIGRKKKGPAKKETTEEGEGAAAAAEETKKSNHVQRKIENRQKDRTLDPHLEEQFGGGRLLACISSRPGQCGRCDGYILEGKELEFYMKKLQKKKGKSGAGAAA

SEQ ID NO: 13856 - protein, 224 aa, Solanum phureja
MGISRDSMHKRRATGGKKKAWRKKRKYELGRQPANTKLSNNKTVRRIRVRGGNVKWRALRLDTGNYSWGSEAVTRKTRILDVVYNASNNELVRTQTLVKSAIIQVDAAPFKQWYLQHYGADIGRKKKGPAKKETTEEGGGAAAAAEETKKSNHVQRKIENRQKDRTLDPHLEEQFGGGRLLACISSRPGQCGRCDGYILEGKELEFYTKKLQKKKGKSGAGAAA

SEQ ID NO: 13857 - protein, 220 aa, Solanum phureja
MGISRDSMHKRRATGGKKKAWRKKRKYELGRQPANTKLVPNAKTVRRIRVRGGNVKWRALRLDTGNFSWGSEAVTRKTRLLDVVYNASNNELVRTQTLVKSAIIQVDAAPFKQWYLQHYGVEIGRKKKTAASKKEGEEAEAVAEEKKSNHVQRKLEKRQQDRKIDPHVEEQFASGRLLAAISSRPGQCGRADGYILEGKELEFYMKKLQKKKGKAAGAAA

SEQ ID NO: 13858 - protein, 224 aa, Nicotiana tabacum
MGISRDSMHKRRATGGKKKAWRKKRKYELGRQPANTKISGNKTVRRIRVRGGNVKWRALRLDTGNYSWGSEATTRKTRILDVVYNASNNELVRTQTLVKSAIVQVDAAPFKQWYLQHYGVDIGRKKKGAAKKETVEEGEGAAAAAEETKKSNHVARKLEKRQKDRKLDAHLEEQFGAGRLLACISSRPGQCGRADGYILEGKELEFYIKKLQKKKGKTGAGGAA

SEQ ID NO: 13859 - protein, 223 aa, Nicotiana tabacum
MGISRDSMHKRRATGGKKKAWRKKRKYELGRQPANTKISGNKTVRRIRVRGGNVKWRALRLDTGNYSWGSEATTRKTRILDVVYNASNNELVRTQTLVKSAIVQVDAAPFKQWYLQHYGVDIGRKKKGAAKKETTEEGEAAAPAEEAKKSNHVARKLEKRQKDRKLDPHLEEQFSAGRLYACISSRPGQCGRADGYILEGKELEFYMKKLQKKKGKAGSGAAA

SEQ ID NO: 13860 - protein, 224 aa, Nicotiana tabacum
MGISRDSMHKRRATGGKKKAWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAKKETAEEGEGAAAAAEETKKSNHVARKLEKRQKDRQLDAHLEEQFGAGRLLACISSRPGQCGRADGYILEGKELEFYMKKLQKKKGKAGAGGAA

SEQ ID NO: 13861 - protein, 224 aa, Valeriana officinalis
MGISRDSMHKRRATGGKKKAWRKKRKYELGRQPANTKLVTGTANKTVRRVRVRGGNVKWRALRLDTGNFSWGSEAVTRKTRLLDVVYNASNNELVRTQTLVKGAIVQVDAAPFKQWYLQHYGVDIGRKKKTVAAAKKEAEDGESAAVEEAKKSNHVVRKIEERQKDRKLDQHVEEQFSGGRLLACISSRPGQCGRADGYILEGKELEFYMKKLQKKKGKSAGAA

SEQ ID NO: 13862 - protein, 221 aa, Juglans hindsii x Juglans regia
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKAAAKKETPEEVEAATEEAKKSNHVLRKLEKRQQGRKLDLHIEEQFGSGRLLACISSRPGQCGRADGYILEGKELEVYMKKLQRKKGKGAGAGAA

SEQ ID NO: 13863 - protein, 223 aa, Citrullus lanatus
ILWIGISRDSMHKRRATGGKKKAWRKKRKYELGRQPANTKLSSDKSIRRIRVRGGNVKWRAFRLDTGNYSWGSEAVTRKTRILDVVYNASNNELVRTQTLVKSAIVQVDAAPFKQWYLQHYGVDIGRKKKSAASAKKDEEADAAATEEVKKSNHVQRKLEKRQEGRKLDPHIEEQFSSGRLMACISSRPGQCGRADGYILEGKELEFYMKKLQRKKGKGAGAA

SEQ ID NO: 13864 - protein, 220 aa, Amsonia hubrichtii
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKGTIKKDATEEGEATVEETKKSNHVQRKLEKRQQGRTLDPHIEEQFGAGRLLACISSRPGQCGRADGYILEGKELEFYMKKLQRKKGKAAGGAA

SEQ ID NO: 13865 - protein, 226 aa, Cephalotaxus harringtonia
MGISRDSMHKRRATGGKKKQWRKKRKYELGRQPAMTKLSSNKTVRRVRVRGGNVKWRALRLDTGNYSWGSEAVTRKTRILDVVYNASNNELVRTQTLVKSAIVQVDAAPFRIWYHQHYGLEIGRKKKAPAAGVSKKETEEGEAAAAAEEEKKKSAHVMRKIEKRLEGHKLDPHMEEQFAGGKLMACISSRPGQCGRADGYILEGKELEFYMKKLQRKKGKGGAGAA

SEQ ID NO: 13866 - protein, 221 aa, Eschscholzia californica
MGISRDSMHKRRATGGKKKAWRKKRKYELGRQPANTKLSSNKTVRRVRVRGGNVKWRALRLDTGNYSWGSETVTRKTRILDVVYNASNNELVRTQTLVKSAIVQVDAAPFKQWYLQHYGLDIGRKKKNTSAAKKDGEEGETAVEEAKKSNHVVRKIEKRQQDHKLDPHIEEQFSGGRLLAAISSRPGQCGRADGYILEGKELEFYMKKLQKKKGKAGAGAA

SEQ ID NO: 13867 - protein, 220 aa, Humulus lupulus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIIQVDAAPFKQWYLQHYGVDIGRKKKTVVSAKKEEDGEAAAEEVKKSNHVVRKLEKRQQERVLDAHIEEQFSGGRLLACISSRPGQCGRSDGYILEGKELEFYMKKLQRKKGKGAGAAA

SEQ ID NO: 13868 - protein, 219 aa, Olea europaea
MGISRDSMHKRRATGGKKKSWRKKRKYELGRQPANTKLSSNKTVRRVRVRGGNVKWRALRLDTGNYSWGSEAVTRKTRILDVVYNASNNELVRTQTLVKSAIVQVDAAPFKQWHLQHYGVDIGRKKKTAAKKEEDTDAVATEETKKSNHVLRKIEKRQQDRKLDPHVEEQFGSGRLLASISSRPGQCGRADGYILEGKELEFYMKKLQKKKGKGTSGAA

SEQ ID NO: 13869 - protein, 221 aa, Primula obconica
MGISRDSMHKRRATGGKKKAWRKKRKYELGRQPANTKLDNNKTVRRIRVRGGNVKWRALRLDTGNFSWGSESTTRKTRVLDVVYNASNNELVRTQTLVKGAIIQVDAAPFKQYYLQHYGVEVGRKKKAAATKKGEEGEAAAATEEEKKSNHVKRKIESRQQDRSLEQHIEDQFAGGRLLAAISSRPGQCGRCDGYILEGKELEFYMKKLQRKKGKGAGAAA

SEQ ID NO: 13870 - protein, 222 aa, Rosa hybrid cultivar
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFRQWYLQHYNVEVGKKKKIAAAKKDTSEEAEAAPVEEAKKSNHLTRKIEKRVQVRTLDSHIEEQFGGGRLLACISSRPGQCGRADGYILEGKELEFYMKKLQRKKGKGAAATA

SEQ ID NO: 13871 - protein, 219 aa, Cucumis melo
MGISRDSMHKRRETGGKKKAWRKKRKYELGRQPANTKLSSDKSIRRIRVRGGNVKWRAFRLDTGNYSWGSEAVTRKTRILDVVYNASNNELVRTQTLVKSAIVQVDAAPFKQWYLQHYGVDIGRKKKTSASAKKEEEGDAGTEEVKKSNHVQRKIEKRQQDRKLDPHIEEQFSSGRLMACISSRPGQCGRADGYILEGKELEFYMKKLQRKKGKGAGAA

SEQ ID NO: 13872 - protein, 218 aa, Orobanche aegyptiaca
MGISRDSMHKRRATGGKKKVWRKKRKYELGRQPANTKLSSNKTVRRVRVRGGNVKWRALRLDTGNYSWGSEAVTRKTRILDVVYNASNNELVRTQTLVKGAIIQVDAAPFKQWYLQHYGVEIGRKKKTAAKKEGEDSEAPDEAVEKSNHLQRKLEKRQQDRKIDPHIEEQFGGGRLLAAISSRPGQCGRADGYILEGKELEFYMKKLQRKKGKGAGGA

SEQ ID NO: 13873 - protein, 219 aa, Orobanche aegyptiaca
MGISRDSMHKRRATGGKKKVWRKKRKYELGRQPANTKLSSNKTVRRVRVRGGNVKWRALRLDTGNYSWGSEAVTRKTRILDVVYNASNNELVRTQTLVKGAIIQVDAAPFKQWYLQHYGVDIGRKKKTAAKKEGEDTEAAAAEALEKSNHLQRKLEKRQQDRKIDSHIEEQFGGGRLLAAISSRPGQCGRADGYILEGKELEFYMKKLQRKKGKGAGAA

SEQ ID NO: 13874 - protein, 219 aa, Salvia sclarea
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYLQHYGVEIGRKKKTAAKKEGEEAEATVTEEVKKSNHVQRKLEKRQQDRKIDQHIEEQFGGGRLLAAISSRPGQCGRCDGYILEGKELEFYMTKLQKKIGKGASGA

SEQ ID NO: 13875 - protein, 222 aa, Castanea mollissima
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKGAIVQVDAAPFKQWYLQHYGVDIGRKKKTTAKKETPEEGEGNTEEREKETKKSNHVARKLEKRQQGRTLDAHIEEQFGGGRLLACISSRPGQCGRSDGYILEGKELEFYMKKIQRKKGKGAAA

SEQ ID NO: 13876 - protein, 220 aa, Nicotiana benthamiana
MGISRDSMHKRRATGGKKKAWRKKRKYELGRQPANTKLVPNAKTVRRIRVRGGNVKWRALRLDTGNYSWGSEAITRKTRLLDVVYNASNNELVRTQTLVKGAIVQVDAAPFKQWYLQHYGVDIGRKKKTAASKKEGEEAEAVPEEKKSNHVQRKLQKRQQDRKIDPHIEEQFSSGRLLAAISSRPGQCGRADGYILEGKELEFYVKKLQRKKGKGASGAA

SEQ ID NO: 13877 - protein, 220 aa, Nicotiana tabacum
  misc_feature (17)..(17): Xaa can be any naturally occurring amino acid
MGISRDSMHKRRATGGXKKAWRKKRKYELGRQPANTKLVPNAKTVRRIRVRGGNVKWRALRLDTGNYSWGSEAITRKTRLLDVVYNASNNELVRTQTLVKSAIVQVDAAPFKQWYLQHYGVDIGRKKKTAASKKEGEEAEAVPEEKKSNHVQRKLQKRQQDRKIDPHIEEQFAGGRLLAAISSRPGQCGRADGYILEGKELEFYMKKLQRKKGKGASGAA

SEQ ID NO: 13878 - protein, 219 aa, Ocimum basilicum
MGISRDSMHKRRATGGKKKAWRKKRKYELGRQPANTKLSANKTVRRVRVRGGNVKWRALRLDTGNYSWGSEAVTRKTRILDVVYNASNNELVRTQTLVKGAIVQVDAAPFKQWYLQHYGVDIGRKKKTVAKKEGEEADTAPTEEAKKSNHVQRKLEKRREDRKIDPHIEEQFGGGRLLAAIASRPGQCGRCDGYILEGKELEFYMKKLQKKKGKGASGA

SEQ ID NO: 13879 - protein, 214 aa, Malus domestica
MHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFKQWYLQHYGVEIGRRKKSAVAKKDTPEEGEGTTEEAKKSNHVARKLEKRQQGRTLDPHIEEQFGGGRLLACISSRPGQCGRCDGYILEGKELEFYMKKLQRKKGKGAGAAA

SEQ ID NO: 13880 - protein, 72 aa, Cucurbita pepo
MGISRDSMHKRRATGGKKKAWRKKRKYELGRQPANTKISSDKSIRRIRVRGGNVKWRALGLILETTLGVVRL

SEQ ID NO: 13881 - protein, 227 aa, Cynara scolymus
  misc_feature (193)..(193): Xaa can be any naturally occurring amino acid
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGLDIGRKKKPAAAATKKEGEEAEVATEETKKSNHVVRKLEKRQEERKLDQHVEEQFSSGRLLAAISSRPGQCGRXDGYILEGKELEFYMKKLQKKKERVVVLLKNIRFL

SEQ ID NO: 13882 - protein, 205 aa, Cynara scolymus
MGISRDSMHKRRATGGKKKAWRKKRKYELGRQPANTKISSNKTVRRVRVRGGNVKWRALRLDTGNYSWGSEAVTRKTRILDVVYNASNNELVRTQTLVKSAIVQVDAAPFKQWYLQHYGVDIGRKKKATTAAKKEGEEVEGATEETKKSNHVARKLEKRQEERKLDPHVEEQFSGGRLLAAISSRPGQCGRADGYILEGKSSSST

SEQ ID NO: 13883 - protein, 224 aa, Solanum melongena
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIIQVDAAPFKQWYLQHYGVDIGRKKKGPTKREATEEGEGVAAAAEETKKSHNVQRKLENRQKDRTLDPHLEEQFGGGRLLACISSRPGQCGRCDGYILEGKELEFYMKKLQKKKGKSGAGAAS

SEQ ID NO: 13884 - protein, 221 aa, Linum usitatissimum
MGISRDSLHKRRATGGKKKVWRKKRKYELGRQPANTKLSSNKTVRRVRVRGGNVKWRALRLDTGSFSWGSEAVSMKCRLLDVVYNASNNELVRTQTLVKSAIVQVDAAPFRQYYLNHYGVEVGRKKKAVAKTAEEGDAATAPAAEETKKSKHVLRKIESRQKDRQLDPHIEEQFSGGRLLACISSRPGQCGRADGYILEGKELEFYMKKLQRKKGKGAGAA

SEQ ID NO: 13885 - protein, 163 aa, Fraxinus spp
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQWYLQHYGVDIGRKKKAANKKEGEEAEGAVEETRKSNHVQRKLAKASTGSEA

SEQ ID NO: 13886 - protein, 223 aa, Taxus baccata
MGISRDSMHKRRATGGKKKQWRKKRKYELGRQPAMTKLSSNKTVRRVRVRGGNVKWRALRLDTGNYSWGSEAVTRKTRILDVVYNASNNELVRTQTLVKSAIVQVDAAPFRIWYQQHYGQEIGRKKKAPTSTKKETEEGEAAATEEEKKKSAHVLRKIEKRNEGHKLDAHMEEQFASGKLMACLSSRPGQCGRADGYILEGKELEFYVKKLQRKKGKGGAGAA

SEQ ID NO: 13887 - protein, 204 aa, Vinca minor
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKHCTFNTTVLTLVGRRRPLLRRMLLRREKLLLKKLRRATMYKGKLKSVSKVVHLMLILRSNLALVDYLHASLPAQDSVADRMVIFWRAKSLSST

SEQ ID NO: 13888 - protein, 208 aa, Ocimum basilicum
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKGAIVQVDAAPFKQWYLQHYGVEIGRKKKAAAKKEGEEADATATEEVKKSNHVQRKQEKRQQDRKIDSHIEEQFGGGRLLAAISSRPGQCGRCDGYILEGKELEFYMKKI

SEQ ID NO: 13889 - protein, 219 aa, Centaurea maculosa
MGISRDSMHKRRATGGKKKAWRKERKYELGRRPAITKISSNKTVRRVRVRGGNVKWRALRLDTGNFSWGSEAVTRKTRILDVVYNASNNELVRTQTLVKSAIVQVDAAPFKQWYLQHYGVDIGRKKKPSATATKKEGEEAEAAAEEAKKSNHVVRKLEKRQEERKLDAHVEEQFSGGRLYAAISSRPGQCGRADGYILEGKELEFYMKKLQKKKGKGAA

SEQ ID NO: 13890 - protein, 219 aa, Actinidia deliciosa
MGISRDSMHKRRATGGKQKAWRKKRKYELGRQPANTKLSNAKTVRRIRVRGGNVKWRALRLDTGNFSWGSEAVTRKTRILDVVYNASNNELVRTQTLVKGAIIQVDVAPFKQWYLQHYGVDIGRKKKTAVSAKKEGEEADAAATEEAKKSNNVLRKLQKRQQDRKLDPHVEEQFGSGRLLAAISSRPGQCGRCDGYILEGKELEFYMKKIQRKKGKGAA

SEQ ID NO: 13891 - protein, 223 aa, Nicotiana tabacum
MGISRDSMHKRRATGGKKKAWRKKRKYELGRQPANTKISGNKTVRRIRVRGGNVKWRALRLDTGNYSWGSEATTRKTRILDVVYNASNNELVRTQTLVKSAIVQVDAAPFKQWYLQHYGVDIGRKKKGASKKETTEEGEAAAPVEEAKKSNHVARKLEKRQKDRKLDPHLEEQFGSGRLYACISSRPGQCGRADGYILEGKELEFYMKKLQKKKGKAGSGAAA

SEQ ID NO: 13892 - protein, 222 aa, Solanum lycopersicum
MGISRDSMHKRRATGGKKKSWRKKRKYELGRQPANTKLSNNKTVRRIRVRGGNVKWRALRLDTGNYSWGSEAVTRKTRILDVVYNASNNELVRTQTLVKSAIIQVDAAPFKQWYLQHYGADIGRKKKGAAKKDTTEEGEAAAPEETKKSNHVQRKIENRQKDRTLDPHLEEQFGGGRLLACISSRPGQCGRCDGYILEGKELEFYMKKLQKKKGKSGAGAAA

SEQ ID NO: 13893 - protein, 221 aa, Fagus grandifolia
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKATTKKETAEEGEAAAEETKKSNHVQRKIEKRQKDRNLDPHIEEQFGGGRLLACISSRPGQCGRSDGCILEGKELEFYMKKLQRKKGKGSAGAGA

SEQ ID NO: 13894 - protein, 220 aa, Petunia hybrida
MGISRDSMHKRRATGGKQKTWRKKRKYELGRQPANTKLVPNEKTVRRIRVRGGNVKWRALRLDTGNYSWGSEAVSRKTRLLDVVYNASNNELVRTQTLVKGAIVQVDAAPFKQWYLHHYGVDVGRKKKTAASKKEGEEAEAVPEEKKSNHVQRKLANRQQDRKIDPHIEEQFASGRLLAAISSRPGQCGRADGYILEGKELEFYMKKLQRKKGKGASGTA

SEQ ID NO: 13895 - protein, 220 aa, Solanum tuberosum
MGISRDSMHKRRATGGKKKAWRKKRKYELGRQPANTKLVPNAKTVRRIRVRGGNVKWRALRLDTGNFSWGSEAVTRKTRLLDVVYNASNNELVRTQTLVKSAIIQVDAAPFKQWYLQHYGVEIGRKKKTAASKKEGEEAEAVAEEKKSNHVQRKLEKRQQDRKIDPHVEEQFASGRLLAAISSRPGQCGRADGYILEGKELEFYMKKLQKKKGKGAGAAA

SEQ ID NO: 13896 - protein, 220 aa, Nicotiana tabacum
MGISRDSMHKRRATGGKKKAWRKKRKYELGRQPANTKLVPNAKTVRRIRVRGGNVKWRALRLDTGNYSWGSEAITRKTRLLDVVYNASNNELVRTQTLVKSAIVQVDAAPFKQWYLQHYGVDIGRKKKTAASKKEGEEAEAVPEEKKSNHVQRKLQKRQQDRKIDPHIEEQFASGRLLAAISSRPGQCGRADGYILEGKELEFYMKKLQRKKGKGASGAA

SEQ ID NO: 13897 - protein, 222 aa, Ipomoea nil
MGISRDSMHKRRATGGKQKAWRKKRKYELGRQSANTKLSSNKTVRRIRVRGGNVKWRALRLDTGNYSWGSEAVTRKTRILDVVYNASNNELVRTQTLVKSAIVQVDAAPFKQWYLQHYAVDIGRKKKGPAKKETAEEGNEGAAVEEAKKSNHVQRKLEKRQKDRKLDPHLEEQFGSGRLMACISSRPGQCGRADGYILEGKELEFYMKKIQRKKGKGAGAAA

SEQ ID NO: 13898 - protein, 219 aa, Olea europaea
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKAAAKKEGEEAEGAVEETKKSNHVERKLQKRQQDRKLDPHVEEQFGSGRLLAAISSRPGQCGRADGYILEGKELEFYMKKLQRKKGKGASGAS

SEQ ID NO: 13899 - protein, 218 aa, Capsicum annuum
RDSMHKRRATGGKKKAWRKKRKYELGRQPANTKISSNKTVRRIRVRGGNVKWRALRLDTGNYSWGSEAVTRKTRILDVVYNASNNELVRTQTLVKSAIVQVDAAPFKQWYLQHYGVDIGRKKKGTAKKETTEDGEAAAPAEEAKKSNHVVRKLEKRQKDRKLDIHLEEQFGSGRLYACISSRPGQCGRADGYILEGKELEFYMKKLQKKKGKASGAAA

SEQ ID NO: 13900 - protein, 224 aa, Phalaenopsis aphrodite
MGISRDSLHKRRATGGKKKAWRKKRKYELGRQPANTKLSSNKTVRRVRVRGGNVKWRALRLDTGNYSWGSEAITRKTRILDVVYNASNNELVRTQTLVKSAIVQVDATPFKQWYLQHYGVELGRKKKAAAATKKDATEGQEGEAAQDEVKKSSHIQRKLEKRQETRKLDAHIEEQFGGGRLLASISSRPGQCGRADGYILEGKELEFYMKKIQRKKGKGAGAAA

SEQ ID NO: 13901 - protein, 225 aa, Festuca arundinacea
MGISRDSMHKRRATGGKMKAWRKKRKYELGRQPANTKLSSNKTVRRVRVRGGNVKWRALRLDTGNFSWGSEAVTRKTRLLDVVYNSSNNELVRTQTLVKNAIVQVDAAPFKGWYLTHYGVDIGRKKKTPAAAKKDAAEGQEGEVTTAATEEAKKSNNVQRKLEKRQQGRTLDAHIEEQFSGGRLLACISSRPGQCGRADGYILEGKELEFYMRKLQKKKGKGASA

SEQ ID NO: 13902 - protein, 219 aa, Lupinus angustifolius
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKGAIVQVDAAPFKQWYLQHYGIEIGRKKKSTTSAKKEGEVAETTTEEAKKSNHVLRKLEKRTQNRVLDPHIEEQFGGGRLLASISSRPGQCGRADGYILEGKELEFYIKKLQRKKGKGAAA

SEQ ID NO: 13903 - protein, 222 aa, Chelidonium majus
MGISRDSMHKRRATGGKKKAWRKKRKYELGRQPANTKLSSNKTVRRVRVRGGNVKWRALRLDTGNFSWGSEAVTRKTRILDVVYNASNNELVRTQTLVKGAIVQVDVAPFKQYCLQHYGLDIGRKKKGAVAAVVAKKDGEEGEAATEEAKKSNHVVRKLEKRQQDHKLDAHIEEQFSGGRLLAAISSRPGQCGRADGYILEGKELEFYMKKLQKKKGKGAAA

SEQ ID NO: 13904 - protein, 219 aa, Cucumis sativus
MGISRDSMHKRRETGGKKKAWRKKRKYELGRQPANTKLSSDKSIRRIRVRGGNVKWRAFRLDTGNYSWGSEAVTRKTRLLDVVYNASNNELVRTQTLVKSAIVQVDAAPFKQWYLQHYGVDIGRKKKTSASVKKEEEGDAGTEEVKKSNHVQRKIEKRQQDRKLDPHIEEQFSSGRLMACISSRPGQCGRADGYILEGKELEFYMKKLQRKKGKGAGAA

SEQ ID NO: 13905 - protein, 222 aa, Linum usitatissimum
MGISRDSLHKRRATGGKKKVWRKKRKYELGRQPANTKLSSNKTVRRVRVRGGNVKWRALRLDTGSFSWGSEAVSMKCRLLDVVYNASNNELVRTQTLVKSAIVQVDAAPFRQYYLNHYGVEVGRKKKAVAKTAEEGDAAAAAPAAEEAKKSKHVLRKIESRQKDRQLDPHIEEQFSGGRLLACISSRPGQCGRADGYILEGKELEFYMKKLQRKKGKGAGAA

SEQ ID NO: 13906 - protein, 223 aa, Zingiber officinale
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKAWYLQHYGIELGKKKKNPAVAKKEATEGQEGEATTEVVKKSSHVLRKLEKRQQDRKLDPHIEEQFGTGRLLASISSRPGQCGRADGYILEGKELEFYQKKIQRKKGKGAGAS

SEQ ID NO: 13907 - protein, 219 aa, Momordica charantia
MGISRDSMHKRRATGGKKKAWRKKRKYELGRQPANTKLSSDKSIRRIRVRGGNVKWRAFRLDTGNYSWGSEAVTRKTRILDVVYNASNNELVRTQTLVKSAIIQVDAAPFKQWYLQHYGVDIGRKKKTSASAKKEEEGDAPSEEAKKSNHVQRKLEKRQQERKLDAHIEEQFSSGRLMACISSRPGQCGRADGYILEGKELEFYMKKLQRKKGKGAGAA

SEQ ID NO: 13908 - protein, 220 aa, Populus trichocarpa
MGISRDSMHKRRATGGKKKAWRKKRKYELGRQPASTKLSSNKTVRRIRVRGGNVKWRALRLDTGNYSWGSEAVTRKTRILDVVYNASNNELVRTQTLVKSAIVQVDAAPFKQWYLQHYGVDIGRKKKAVVKKETPEQEGEATTEETKKSNHVIRKLEKRQQVRKLDPHIEEQFGSGRLLASISSRPGQCGRADGYILEGKELEFYMKKIQRKKGKGAGAA

SEQ ID NO: 13909 - protein, 223 aa, Tripterygium wilfordii
MGISRDSMHKRRSTGGKKKAWRKKRKYELGRQSANTKLSSNKTVRRVPVRGGNVKWRALRLDTGNYSWGSEAVTRKTRILDVVYNASNNELVRTQTLVKSAIVQVDAAPFRQWYLQHYGVDIGRKKKVAAKKETTEEGETVAEETKKSNHVIRKLEKRQKDRKLDAHIEEQFGAGRLMACISSRPGQCGRADGYILEGKELEFYMKKIQRKKGKGSAGAGAAA

SEQ ID NO: 13910 - protein, 206 aa, Cleome gynandra
SRSNGRKKRKYEMGRVAANTKLSSNKTVRRVRVRGGNVKWRALRLDTGNYSWGSEAVTRKTRILDVVYNASNNELVRTKTLVKSAIVQVDAAPFKQWYLQHYGVEVGRKKKTATTSGKKEGEEGEDSAAAPEEAKKSNHVLRKLEKRQQNRTLDAHIEDQFASGRLLACISSRPGQCGRADGYILEGKELEFYMKKIQKKKGKGTA

SEQ ID NO: 13911 - protein, 223 aa, Tropaeolum majus
MGISRDSMHKRRATGGKKKAWRKKRKYELGRQPANTKLSSNKTVRRIRVRGGNVKWRALRLDTGNFSWGSEAVTRKTRLLDVVYNASNNELVRTQTLVKSAIVQVDAAPFKQWYLQHYGVEIGRKKKTAVSAKKEGEEVEAATEEAKKSNHVTRKLEKRQQTRELDSHIEEQFGGGRLLACIASRPGQCGRADGYILEGKELEFYMKKLQKRRGKELPKILLP

SEQ ID NO: 13912 - protein, 223 aa, Nicotiana benthamiana
MGISRDSMHKRRATGGKKKAWRKKRKYELGRQPANTKISSNKTVRRIRVRGGNVKWRALRLDTGNYSWGSEATTRKTRILDVVYNASNNELVRTQTLVKSAIVQVDAAPFKQWYLQHYGVDIGRKKKGAAKKETAEEGEGAAAAEETKKSNHVARKLEKRQKDRKLDAHLEEQFGAGRLLACISSRPGQRGRADGYILEGKELEFYMKKLQKKKGKAGAGGAA

SEQ ID NO: 13913 - protein, 224 aa, Nicotiana benthamiana
MGISRDSMHKRRATGGKKKAWRKKRKYELGRQPGNTKISSNKTVRRIRVRGGNVKWRALRLDTGNYSWGSEATTRKTRILDVVYNASNNELVRTQTLVKSAIVQVDAAPFKQWYLQHYGVDIGRKKKGAAKKETVEEGEGAAAVAEETKKSNHVARKLEKRQKDRELDAHLEEQFGAGRLLACISSRPGQCGRADGYILEGKELEFYMKKLQKKKGKAGAGGAA

SEQ ID NO: 13914 - protein, 223 aa, Carica papaya
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIIQVDAAPFKQWYLQHYGIDIGRKKKAAVSKKESTEEGEAPAAEETKKSSHVLKKLEKRQKDRKLDPHIEEQFGAGRLLACISSRPGQCGRADGYILEGKELEFYMKKLQRKKGKGGAGAAA

SEQ ID NO: 13915 - protein, 221 aa, Solanum phureja
MGISRDLMHKRHATGGKKKAWRKKRKYEMGRQFANTKLVPNAKTVRRIRVRGGNVKWRALRLDTGNYSWGSEVVTRKTRLLDVVYNASNNELVRTQTLVKSAIVQVDAAPFKQWYLQHYGVEIGCKKKSVAKKEGEEAAEAAAEEKKSNHVQRKLEKRQQDRKIDPHVEEQFASGRLLAAISSRPGQCGRADGYILEGKELEFYMKKLQKKKGKGASGATA

SEQ ID NO: 13916 - protein, 224 aa, Persea americana
MGISRDSMHKRRATGGKKKAWRKKRKYELGRQPANTKLSGNKTVRRVRVRGGNVKWRALRLDTGNYSWGSEAVTRKTRILDVVYNASNNELVRTQTLVKGAIIQVDAAPFKQWYLQHYGIDIGRKKKAPVAKKEAAEGQDGEAPVEEAKKSNHVVRKLEKRQEGQKLDAHIEEQFSSGRLLAAIASRPGQCGRADGYILEGKELEFYMKKIQRKKGKGGAGAAA

SEQ ID NO: 13917 - protein, 547 aa, Chelidonium majus
MLRFRSQAKLILPTFLFIASTFFFSHGVSQAPSLQTLLPQDMVNGKVNGQLNQVLLSTDGNDTNLYNSTLVLAAKRTHRKDPLNSFKRYTGGWNISEEHYWASVGFTAVPLFVIAGVWFVIFGLSLFLVCTCHFCCRKEPYGYSRIAYALSLILLILFTITAIVGCVVLYTGQGKFHGITTDTLGYVVKQGNLTVENLNNVSNYLASAKKITVDKVFLPSDMQTKIDEIQTKINTSANTLAKRTDENQDQIKDLLDNTRLALIIIAAVMLFLAFLGFIFSIFGMTFLVSILVVIGWILVAGTFILCGVFLLLHNVVADTCVSMDEWVAHPTAYTALDDILPCVDNKTAAETLTRTKEATKQLVGVVNQVITNVSNINFSPNFAPLYFNQSGPLIPVLCDPFTADLSDRQCSTGEVDLDNATQVWQSYVCQVSSTGICTTVGRITPDFYTQMSAAVNVSYGLYHYGPFLVNLEDCTFVRETFTEISRDYCPGLRRYSQWTYIGLVMVSGAVMLSLIFWVIYARERRHRVYTKQFLVSGQGAFEEHKNS

SEQ ID NO: 13918 - protein, 219 aa, Eschscholzia californica
MGISRDSMHKRRATGGKKKAWRKKRKYELGRQPANTKLSSNKTVRRVRVRGGNVKWRALRLDTGNYSWGSETVTRKSRILDVVYNASNNELVRTQTLVKSAIVQVDAAPFKQWYLQHYGLDIGRKKKSTSAKKEAEEGEAVEEAKKSNHVVRKIEKRQVDHKLDPHIEEQFSGGRLLAAISSRPGQCGRADGYILEGKELEFYMKKLQKKKGKAGAGAA

SEQ ID NO: 13919 - protein, 227 aa, Ipomoea batatas
MGISRDSMHKRRATGGKKKAWRKKRKYELGRQPASTKLSSNKTVRRVRVRGGNVKWRALRLDTGNYSWGSEAVTRKTRILDVVYNASNNELVRTQTLVKSAIVQVDAAPFKQWYLQHYGVDIGRKKKGAAKKETSEETEGAAAEEAKKSNHVQRKLEKRQKDRKLDSHLEEQFGSGRLMACISSRPGQCDRADGYILEGKELEFYMKTIQRKKGKGSGAAAYFAVKI

SEQ ID NO: 13920 - protein, 204 aa, Quercus alba
MGISRDSMHKRRATGGKKKAWRKKRKYELGRQPANTKLSSNKTVRRIRVRGGNVKWRALRLDTGNYSWGSEAVTRKTRILDVVYNASNNELVRTQTLVKSAIVQVDAAPFKQWYLQHYGVDIGRKKKTAAKKETPEEGEGNTEEREKETKKSNHVARKLEKRQQGRTLDAHIEEQFGGGRLLACISSRPGQCDTFWKEKNLSSI

SEQ ID NO: 13921 - protein, 216 aa, Physcomitrella patens
MGISRDSTHKRRATGGKKKSWRKKRKYELGRQGAMTKLSSNKTVRRIRVRGGNSKFRALRLDTGNFSWGSEAVTRKTRVLDVVYNASNNELVRTQTLVKNAIIQVDAAPFRTWYSQHYGVEIGKKKKAAAKKDTEDAETTEEEKKSAHVQRKLAKRLEGQKLDSHLEDQFASGRLLACIASRPGQCGRADGYILEGKELEFYQKKIQKKKGKGAAA

SEQ ID NO: 13922 - protein, 220 aa, Platanus occidentalis
MGISRDSMHKRRATGGKKKAWRKKRKYELGRQPANTKLSSNKTVRRVRVRGGNVKWRALRLDTGNYSWGSKAVTRKTRILDVVYNASNNELVRTQTLVKSAIVQVDAAPFKQWYLQHYGLDIGRKKKSSATAKKEGEEGEAAEEAKKSNHVLRKLEKRQQEHKLDTPIEEQFGGGRLLAAISSRPGQCGRADGYILEGKELEFYMKKLQRKKGKAAGGAA

SEQ ID NO: 13923 - protein, 222 aa, Sarracenia psittacina
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKGAIVQVDAAPFKQWYLQHYGVDIGRKKKTSASAKKEGEVEGDAAIEETKKSSHVLRKLKDRQEDRKLDPHVEEQFGGGRLLAAIASRPGQCGRADGYILEGKELEFYMKKLQRKKGKSAGGAA

SEQ ID NO: 13924 - protein, 221 aa, Carpinus betulus
MGISRDSMHKRRATGGKKKAWRKKRKYELGRQAANTKLSSNKTVRRIRVRGGNVKWRALRLDTGNYSWGSEAITHKTRILDVVYNASNNELVRTQTLVKGAIVQVDVAPFKQWYHQHYGVDIGRKKKAAAKKDAPEEGEGTATEETKKSNHVVRKLEKRQQGRTLDPHIEEQFGSGRLLACISSRPGQCGRADGYILEGKELEFYMKKLQRKKGKATGAAA

SEQ ID NO: 13925 - protein, 220 aa, Nicotiana benthamiana
MGISRDSMHKRRATGGKKKAWRKKRKYELGRQPANTKLVPNAKTVRRIRVRGGNVKWRALRLDTGNYSWGSEAITRKTRLLDVVYNASNNELVRTQTLVKSAIVQVDAAPFKLWYLQHYGVDIGRKKKTAASKKEGEEAEAVPEEKKSNHVQRKLQKRQQDRKIDPHIEEQFASGRLLAAISSRPGQCGRADGYILEGKELEFYMKKLQRKKGKGASGAT

SEQ ID NO: 13926 - protein, 229 aa, Musa acuminata
PLLMLAGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDATPFKHWYLQHYGVEIGRKKKAPAAAKKEATEVPEGEAAAEEAKKSNHVTRKLEKRQQGRTLDPHIEEQFGAGRLLACISSRPGQCGRADGYILEGKELEFYMKKIQRKKGKGAGAAA

SEQ ID NO: 13927 - protein, 221 aa, Vitis vinifera
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKTTAKKETTEEGEGGATEETKKSNHVLRKLEKRQQDHRLDPHIEEQFGSGRLLASISSRPGQCGRADGYILEGKELEFYMKKIQRKKGKGSAGAA

SEQ ID NO: 13928 - protein, 219 aa, Olea europaea
MGISRDSMHKRRATGGKKKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLQHYGVDIGRKKKAAVKKEGEETEGAVEETKKSNHVQRKLQKRQQDRKLDPHVEEQFGGGRLLAAISSRPGQCGRADGYILEGKELEFYMKKLQRKKGKGASGAS

SEQ ID NO: 13929 - protein, 221 aa, Sciadopitys verticillata
MGISRDSMHKRRATGGKKKQWRKKRKYELGRQPAMTKLSSNKTVRRVRVRGGNVKWRALRLDTGNYSWGSEAVSRKTRILDVVYNASNNELVRTQTLVKSAIVQVDAAPFRIWYQQHYGQDIGRKKKAVAAKKETEEGEAAAEEEKKKSNHVLRKIEKRQEGHKLDAHLEEQFAGGKMLACISSRPGQCGRCDGYILEGKELEFYMKKLQRKKGKGGAGAA

SEQ ID NO: 13930 - protein, 266 aa, Raphanus sativus
MTVIDILTRVDTICKKYDKYDVDKQRESNISGDDAFARLYGAFETQIETALEKAEIVTKEKNRASAVAMNAEIRRTKARLSEEVPKLQRLALKRVKGLTTEELAARNDLVLALPARIEAIPDGTAGGPKSTTSAWAPSTTSRPDIKFDSDGRFDDDYFQESHESSQFKQEFEMRKIKQDQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13931 - protein, 266 aa, Brassica napus
MTVIDILTRVDTICKKYDKYDVDKQRESNISGDDAFARLYGAFETQIETALEKAEIVTKEKNRASAVAMNAEIRRTKARLAEEVPKLQRLAVKRVKGLTTEELAARNDLVLALPARIEAIPDGTAGGTKSTSSAWAPSATSRPDIKFDSDGRFDDDYFQESHESSQFRQEFEMRKIKQDQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13932 - protein, 265 aa, Unknown
  Sequence found in Organisms: Eutrema halophilum, Eutrema parvulum
MTVIDILTRVDSICKKYDKYDVDKQREANISGDDAFARLYGAFETQIETALEKAELVTKEKNRASAVAMNAEIRRTKARLSEEVPKLQRLAVKRVKGLTTEELAARNDLVLALPARIEAIPDGTAGGPKSTSAWAPSTTSRPDIKFDSDGRFDDDYFQESHESSQFRQEYEMRKMKQEQGLDMISEGLDALKNMASDMNEELDRQVPLMDEIDTKVDRATSDLKNTNVRLKDTVNQLRSSRNFCIDIVLLCIVLGIAAYLYNVLK

SEQ ID NO: 13933 - protein, 265 aa, Eutrema halophilum
MTVIDILTRVDSICKKYDKYDVDKQREANISGDDAFARLYGAFETQIETALEKAELVTKEKNRASAVAMNAEIRRTKARLSEEVPKLQRLAVKRVKGLTTEELAARNDLVLALPAGIEAIPDGTAGGPKSTSAWAPSTTSRPDIKFDSDGRFDDDYFQESHESSQFRQEYEMRKMKQEQGLDMISEGLDALKNMASDMNEELDRQVPLMDEIDTKVDRATSDLKNTNVRLKDTVNQLRSSRNFCIDIVLLCIVLGIAAYLYNVLK

SEQ ID NO: 13934 - protein, 265 aa, Brassica rapa
MTVIDILTRVDSICKKYDKYDVDKQREANVSGDDAFARLYGAFETQIETALEKAELVTKEKNRASAVAMNAEIRRTKARLSEEVPKLQRLAVKRVKGLTTEELAARNDLVLALPARIEAIPDGTAGGPKATSAWAPSTASRPDIKFDSDGRFDDDYFQESHESSQFRQEYEMRKIKQEQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13935 - protein, 265 aa, Brassica napus
MTVIDILTRVDSICKKYDKYDVDKQREANVSGDDAFARLYGAFDTQIETALEKAELVTKEKNRASAVAMNAEIRRTKARLSEEVPKLQRLAVKRVKGLTTEELAARNDLVLALPARIEAIPDGTAGGPKATSAWAPSTASRPDIKFDSDGRFDDDYFQESHESSQFRQEFEMRKIKQEQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13936 - protein, 266 aa, Arabidopsis thaliana
MTVIDILTRVDSICKKYDKYDVDKQREANISGDDAFARLYGAFETQIETALEKAELVTKEKNRAAAVAMNAEIRRTKARLSEEVPKLQRLAVKRVKGLTTEELAARNDLVLALPARIEAIPDGTAGGPKSTSAWTPSSTTSRPDIKFDSDGRFDDDYFQESNESSQFRQEYEMRKIKQEQGLDMISEGLDALKNMASDMNEELDRQVPLMDEIDTKVDRATSDLKNTNVRLKDTVNQLRSSRNFCIDIVLLCIVLGIAAYLYNVLK

SEQ ID NO: 13937 - protein, 266 aa, Brassica oleracea
  misc_feature (12)..(12): Xaa can be any naturally occurring amino acid
  misc_feature (81)..(81): Xaa can be any naturally occurring amino acid
  misc_feature (144)..(144): Xaa can be any naturally occurring amino acid
MTVIDILTRVDXICKKYDKYDVDKQREANVSGDDAFARLYGAFDTQIETALEKAELVTKEKNRASAVAMNAEIRRTKARLXEEVPKLQRLAVKRFKGLTTEELAARNDLVLALPARIEAIPDGTAGGTKSTTSAWAPSTTSRPXIKFDSDGRFDDDYFQESHESSQFRQEFEMRKIKQDQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13938 - protein, 266 aa, Arabidopsis lyrata
MTVIDILTRVDSICKKYDKYDVDKQREANISGDDAFARLYGAFETQIETALEKAELVTKEKNRAAAVAMNAEIRRTKARLSEEVPKLQRLAVKRVKGLTTEELAARNDLVLALPARIEAIPDGTAGGPKNTSGWTPSSTTSRPDIKFDSDGRFDDDYFQESHESSQFRQEYEMRKIKQEQGLDMISEGLDALKNMASDMNEELDRQVPLMDEIDTKVDRATSDLKNTNVRLKDTVNQLRSSRNFCIDIVLLCIVLGIAAYLYNVLK

SEQ ID NO: 13939 - protein, 265 aa, Eutrema parvulum
MTVIDILTRVDSICKKYDKYDVDKQREANISGDDAFARLYGAFETQIETALEKAELVTKEKNRASAVAMNAEIRRTKARLSEEVPKLQRLAVKRVKGLTTEELAARNDLVLALPARIEAIPDGTAGGPKSTSAWTPATASRPDIKFDSDGRFDDDYFQESNESSQFRQEYEMRKMKQEQGLDMISEGLDALKNMASDMNEELDRQVPLMDEIDTKVDRATSDLKNTNVRLKDTVNQLRSSRNFCIDIVLLCIVLGIAAYLYNVLK

SEQ ID NO: 13940 - protein, 265 aa, Raphanus sativus
MTVIDILTRVDSICKKYDKYDVDKQRDANVSGDDAFARLYGAFEEQIETALEKAELVTKEKNRASAVAMNAEIRRTKARLSEEVPKLQRLAVKRVKGLTTEELAARNDLVLALPARIDAIPDGTAGGPKATSAWAPSTASRPDIKFDSDGRFDDDYFQESHESSQFRQEYEMRRIKQEQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13941 - protein, 258 aa, Arabidopsis lyrata
MTVIDILTRVDSICKKYDKYDVDKQREANISGDDAFARLYGAFETQIETALEKAELVTKEKNRAAAVAMNAEIRRTKARLSEEVPKLQRLAVKRVKGLTTEELAARNDLVLALPARIEAIPDGTAGGPKNTSGWTPSSTTSRPDIKFDSDGRFDDDYFQESHESSQFRQEYEMRKIKQARLDALKNMASDMNEELDRQVPLMDEIDTKVDRATSDLKNTNVRLKDTVNQLRSSRNFCIDIVLLCIVLGIAAYLYNVLK

SEQ ID NO: 13942 - protein, 230 aa, Raphanus sativus
SLVSTELPRLKSRQLSRKLRCTKEKNRASAVAMNAEIRRTKARLSEEVPKLQRLALKRVKGLTTEELAARNDLVLALPARIEAIPDGTAGGPKSTTSAWAPSTTSRPDIKFDSDGRFDDDYFQESHESSQFKQEFEMRKIKQDQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 13943 - protein, 231 aa, Brassica napus
VIDILTRVDSICKKYDKYDVDKQREANVSGDDAFARLYGAFETQIETALEKAELVTKEKNRASAVAMNAEIRRTKARLSEEVPKLQRLAVKRVKGLTTEELAARNDLVLALPARIEAIPDGTAGGPKATSAWAPSTASRPDIKFDSDGRFDDDYFQESHESSQFRQEYEMRKIKQEQGLDMISEGLDALKNMASDMNEELDRQVPLMDEIDSKVTEQPRILKTPMLDLKIL

SEQ ID NO: 13944 - protein, 267 aa, Theobroma cacao
MSVIDILTRVDVICKRYDKYDVEKQRDQNVSGDDAFARLYAAVEADIESALQKGELASKEKSKASAVAVNAEIRRTKARLLEEVPKLQRLAVKKVKGISTEELAARNDLVLALPDRIQAIPDGTSAPKQTGGWMSSAPSASRNEIKFDSDGRFDNEYFQESEQSSQFRQEYEMRRMKQDQGLDMISEGLDTLKNMAHDMNEELDRQVPLMDEIDTKVDKAAADLKNTNVRLKDTVNQLRSSRNFCIDIVLLCIVLGIAAYLYNVLKK

SEQ ID NO: 13945 - protein, 265 aa, Vitis vinifera
MTVIDILTRVDAICKKYDKYDIDKQKDLNVSGDDAFARLYAVVEADIEAALQKADTASNEKNRASAVALNAEIRRTKARLLEEVPKLQRLAIKKVKGLSTEELAARNDLVLALPDRIQAIPDGAATAPKQTGGWAASASRTEIKFDSDGRFDSEYFQQTEESSQFRQEYEMRKMNQDQGLDVIAEGLDTLKNMAHDMNEELDRQVPLMDEIDTKVDKATADLKNTNVRLKDTVNQLRSSRNFCIDIILLCIILGIAAYLYNVLKK

SEQ ID NO: 13946 - protein, 465 aa, Arabidopsis thaliana
MAMSVNVSSSSSSGIINSRFGVSLEPKVSQIGSLRLLDRVHVAPVSLNLSGKRSSSVKPLNAEPKTKDSMIPLAATMVAEIAEEVEVVEIEDFEELAKKLENASPLEIMDKALEKYGNDIAIAFSGAEDVALIEYAHLTGRPFRVFSLDTGRLNPETYRFFDAVEKHYGIRIEYMFPDSVEVQGLVRSKGLFSFYEDGHQECCRVRKVRPLRRALKGLKAWITGQRKDQSPGTRSEIPVVQVDPVFEGLDGGVGSLVKWNPVANVEGNDVWNFLRTMDVPVNTLHAAGYISIGCEPCTKAVLPGQHEREGRWWWEDAKAKECGLHKGNVKENSDDAKVNGESKSAVADIFKSENLVTLSRQGIENLMKLENRKEPWIVVLYAPWCPFCQAMEASYDELADKLAGSGIKVAKFRADGDQKEFAKQELQLGSFPTILVFPKNSSRPIKYPSEKRDVESLTSFLNLVR

SEQ ID NO: 13947 - protein, 473 aa, Cleome gynandra
MALAVTASSSSSSSVIPSSGFPRLGFHSDIKVTQIGSLRLVDSFNVVAPSSLTLSGRNSLVKPLNAEPKTLKAVVPLAAATTVAPEVEENVEVENFEELATRLENASPLEIMDKALEKFGEDIAIAFSGAEDVALLEYARLTGRPFRVFSLDTGRLNPETYRFFDAVEKHYGIRIEYMFPDAVEVQALVRNKGLFSFYEDGHQECCRVRKVRPLRRALKGLRAWITGQRKDQSPGTRSEIPIVQVDPVFEGMDGGVGSLVKWNPVANVQGNDIWNFLRTMDVPVNTLHAEGYVSIGCEPCTRAVLPGQHEREGRWWWEDAKAKECGLHKGNIKENTNGNGNGNGSANVNGQSTVADIFNSENLVTLSRPGIHNLLKLENRKEPWIVVLYAPWCPFCQAMEASYIELANKLSQSGVKVAKFRADGDQKEYAKQELQLGSFPTILVFPKNSARPIKYPSEKRDVDSLMSFVNLVR

SEQ ID NO: 13948 - protein, 238 aa, Gossypium hirsutum
MENCYPLSFLEPPNCDGFNAAAISNEPPFIVPWPIEPLFSASSSVRCHGFTSPAIPDKATVASKSHSEAEKRRRDRINSQLTALRKLIPKSNKMDKAALLGSAIEQVKDLKRKATEIGKAFAIPSETDEVSVDYNVPEDKTFIRVSICCDDRPEVFSELIRVLKGLRLSIVEAEISSVGGRTKSNLILCNESDNREGVSSTLKQSLNIVVNKINALSSDESKSSCRIRSKRQRLFLSS

SEQ ID NO: 13949 - protein, 203 aa, Unknown
  Sequence found in Organisms: Gossypium hirsutum, Gossypium raimondii
MQRAVRAFSVHGNTLKNAILHRIRVVNPVMRPVMFSRSLTSASMEEHGFESTTISDVLKAKGKGADGSWLWCTTDDSVYDAVKSMTQHNVGALVVVKPGEQKSIAGIITERDYLRKIIVHGRSSKSTKVGDIMTEENKLITVTPETKVLQAMQLMTENRIRHIPVINEKEMVGMVSIGDVVRAVVSEHRAELDRLNAYIQGGY

SEQ ID NO: 13950 - protein, 205 aa, Theobroma cacao
MKGAVQAFLLHGNTVKNAVLQRIRVVNPVKRPIIFSRFESVSSARMEEHGFESTTIADILKAKGKGADGSWLWCTTDDTVYNAVKSMTQHNVGALVVVKPGEQESIAGIITERDYLRKIIVQGRSSKSAKVGDIMTEENKLITVTPETKVLRAMQLMTDNRIRHIPVIDEKGMVGMVSIGDVVRAVVIEHREELDRLNAYIQGGY

SEQ ID NO: 13951 - protein, 205 aa, Theobroma cacao
MIGAVQAFLLHGNTVKNAVLQRIRVVNPVKRPIIFSRFESVSSARMEEHGFESTTIADILKAKGKGADGSWLWCTTDDTVYNAVKSMTQHNVGALVVVKPGEQESIAGIITERDYLRKIIVQGRSSKSAKVGDIMTEENKLITVTPETKVLRAMQLMTDNRIRHIPVIDEKGMVGMVSIGDVVRAVVIEHREELDRLNAYIQGGY

SEQ ID NO: 13952 - protein, 205 aa, Manihot esculenta
MQGAVNAFLSHGNLVKNAVLQRFRVANPVLRPILFSRFESVSSARMEEQSFESTTISDILKAKGKGADGSWLWCTTEDSVYDAVKSMTHHNVGALVVVKPGEQKSIAGIITERDYLRKIIVQGRSSKSTKVGDIMTEENKLITVTPDTKVLRAMQLMTDNRIRHIPVIDDKGMIGMVSIGDVVRAVVTEHREELDRLNAYIQGGY

SEQ ID NO: 13953 - protein, 205 aa, Tropaeolum majus
MQRAMQAVFVHGNTVKNAVLQHVRVINPVLRPMILSRSESVSASRMEEQGFESTTIADILKAKGKNADGSWLWCTTDDSVYDAVKSMTQHNVGALVVVKPGEQKSVAGIITERDYLRKIIVQGRSSKSTKVGDIMTEENKLITVTPDTKVLRAMQLMTENRIRHIPVIETAGMIGMVSIGDVVRAVVSEHREELDRLNAYIQGGY

SEQ ID NO: 13954 - protein, 205 aa, Prunus persica
MQGAFKAFSSHGNIVKNGVLRHIRLVNPLIQPVAFSRFESATPARIEEHGFESTRIADILKGKGKGADGSWLWCTTDDSVYDAVKSMTQHNVGALVVVKPGEQKSIAGIITERDYLRKIIVQGRSSKSTKVGDIMTEENKLITVTPDTKVLRAMQLMTDNRIRHIPVIDDRGMIGMVSIGDVVRAVVSEHREELDRLNAYIQGGY

SEQ ID NO: 13955 - protein, 205 aa, Vitis vinifera
MQGAIQAIVSHGSIVKNAVLHQIRLVNPIMPSVVFSRLQSVTSARMEEHGFESTTIADVLKGKGKSADGSWLWCTTDDSVYDAVKSMTHHNVGALVVVKPGEQKSIAGIITERDYLRKIIVQGRSSKSTKVGDIMTEENKLITVSPNTKVLRAMQLMTDNRIRHIPVIDDKEMIGMVSIGDVVRAVVTEHREELDRLNAYIQGGY

SEQ ID NO: 13956 - protein, 205 aa, Manihot esculenta
MQRAVSAFLSHGDLVKNAVLQRFRVANPVLRPILFSRFESVSSARMEEQSFESTTIADILKAKGKGADGSWLWCTTDDTVYDAVKSMTHHNVGALVVVKPGEQKSLAGIITERDYLRKIIVQGRSSKSTKVGDIMTEENKLITVTPHTKVLQAMQLMTDNRIRHIPVIDDKDMIGMVSIGDVVRAVVTEHREELDRLNAYIQGSY

SEQ ID NO: 13957 - protein, 205 aa, Unknown
  Sequence found in Organisms: Citrus clementina, Citrus sinensis
MQGAIQSFLSHGNIVKSAVLQRIRLVNPMLRPVVSSRFESVSSARMEEHGFESTTISDILKAKGKGADGSWLWCTTDDTVYDAVKSMTQHNVGALVVVKPGEQKSVAGIITERDYLRKIIVQGRSSKSTKVGDIMTEENKLITVSPDTKVLRAMQLMTDNRIRHIPVIDDKGMIGMVSIGDVVRAVVSEHREELNRLNAFIQGGY

SEQ ID NO: 13958 - protein, 205 aa, Fragaria vesca
MQGALKAFSSQGNFVKNAVLRHVRVVNPLIQPALFSRFESVAPARIEEHGFESTKIADVLNAKGKGADGSWLWCTTDDSVYDAVKSMTQHNVGALVVVKPGEQKSIAGIITERDYLRKIIVQGRSSKSTKVGDIMTEENKLITVTPDTKVLRAMQLMTDNRIRHIPVIDDRGMLGMVSIGDVVRAVVSEHREELDRLNAFIQGGY

SEQ ID NO: 13959 - protein, 206 aa, Cucumis sativus
MQGAVRSFLSHGNVVKTAVLQQIRVANPHMRPAMLSRFSTSASSANIEEHGFESTTIDDILKAKGKSADGSWLWCTTEDSVYDAVQSMTQHNVGALVVVKPAEQNSIAGIITERDYLRKIIVQGRSSKSTKVGDIMTEENKLITVTPDTKVLLAMQLMTDNRIRHIPVIDEKGMKGMVSIGDVVRAVVSEHREELDRLNAYIQGGY

SEQ ID NO: 13960 - protein, 206 aa, Citrullus lanatus
MQGAVRSFLSHGNVVKTAVLQQIRVANPHMRPAMLSRFSTSASSVNMEEHGFESTTIDDILKAKGKSADGSWLWCTTEDTVYDAVQSMTQHNVGALVVVKPAEQNSIAGIITERDYLRKIIVQGRSSKSTKVGDIMTEENKLITVTPDTKVLRAMQLMTDNRIRHIPVIDDKGMKGMVSIGDVVRAVVSEHREELDRLNAYIQGGY

SEQ ID NO: 13961 - protein, 205 aa, Aristolochia fimbriata
MQGAIRAIRVRSSVIKNAVLQHIRVVDPVVQPAIFSRYESAPSTRLEEHGFESTTISDILKVKGKSADGSWLWCTTDDSVYDAVKSMTQHNVGALVVVKPGEQKSIAGIITERDYLRKIIVQGRSSKSTKVGDIMTEENKLITVTPDTKVLRAMQLMTDNRIRHIPVIDDKEMIGMVSIGDVVRAVVSEHREELNRLNAYIQGGY

SEQ ID NO: 13962 - protein, 205 aa, Cleome gynandra
MQAVIRAFVSGGNVAKAAVLHHLRVINPAIQPAVFSRSESTQSARIEEHGFESTTISDILKAKGKSADGSWLWCTTDDSVYDAVKSMTQHNVGALVVVKPGEQQSIAGIITERDYLRKIIVQGRSSKSTKVGDIMTEENKLITVTPDTKVLRAMELMTDNRIRHIPVINDKEMMGMVSIGDVVRAVVTEHREELNRLNAYIQGGY

SEQ ID NO: 13963 - protein, 205 aa, Cleome spinosa
MQAAIRAFVSGGNVAKSAVLRHFRVINPAIQPAVFSRSESTQSTGIEEHGFESTTISDILKAKGKSADGSWLWCTTDDSVYDAVQSMTQHNVGALVVVKPGEQQSIAGIITERDYLRKIIVQGRSSKSTKVGDIMTEENKLITVTPDTKVLWAMQLMTDNRIRHIPVIDDKEMVGMVSIGDVVRAVVTEHREELDRLNAYIQGGY

SEQ ID NO: 13964 - protein, 205 aa, Carica papaya
MQGVMQAIFVRGSTVKNAILQHVRIANPVIRPLIFSRLESVSSARMEEHGFESTTIADILKGKGKNADGSWLWCTTDDSVYDAVKSMTQNNVGALVVLKPGEQKSIAGIITERDYLRKIIVQGRSSKSTKVGDIMTEENKLITVKPDTKVLRAMQLMTDNRIRHIPVIDDKGMIGMVSIGDVVRAVVSEHREELDRLNAYIQGGY

SEQ ID NO: 13965 - protein, 205 aa, Platanus occidentalis
MQGAIQAIRSHGNILKHAILQHIRLLNPVLRPVLFLRFESASSARLEEHGFESTTIQDILKAKGKSADGSWLWCTTDDTVYDAVKSMTQHNVGALVVVKPGEQKSIAGIITERDYLRKIIVQGRLSKSTKVGDIMTEENKLITVTPDTKVLRAMQLMTDNRIRHIPVIDDKEMIGMVSIGDVVRAVVSEYREELDRLNAYIQGGY

SEQ ID NO: 13966 - protein, 205 aa, Prunus mume
MQGAFKAFSSHGNIVKNGVLRHIRLVNPLIQPVAFSRFESATPARIEEHGFESTRIADILRGKGKGADGSWLWCTTDETVYDAVKSMTQHNVGALVVVKPGEQKSIAGIITERDYLRKIIVQGRSSKSTKVGDIMTEENKLITVTPDTKVLRAMQLMTDNRIRHIPVIDDTGMIGMVSIGDVVRAVVSEHREELDRLNAYIQGGY

SEQ ID NO: 13967 - protein, 207 aa, Chelidonium majus
MQGAAIQAIRSHGNMFKNAILQHIRFADPITRPALFSRFDSFSSTPRLEEHGFESTTILDILKGKGKNADGSWLWCTTDDSVYDAVKSMTQHNVGALVVVKPGEQKSIAGIITERDYLRKIIVQGRSSKSTKVGDIMTEENKLITVTPDTKVLRAMQLMTDNRIRHIPVINDKEMMGMVSIGDVVRAVVSEHREELDRLNAYIQGGY

SEQ ID NO: 13968 - protein, 207 aa, Taraxacum officinale
MQGGIRALVSQGSIVKNALLQHVRVVNMNTLRPLMLSRSESTSAAPRMEEHGFESTTISDILKGKGKGADGSWLWCTTDDSVYDAVKSMTQHNVGALVVVKPGEQSAIAGIITERDYLRKIIVQGRSSKSTKVGDIMTEENKLITVTPDTKVLKAMQLMTDNRIRHIPVINDKEMLGMVSIGDVVRAVVSEHREELNRLNAFIQGGY

SEQ ID NO: 13969 - protein, 206 aa, Cucumis melo
MQGAVRSFLSHGNVVKTAVLQQIRVANPHMRPAMLSRFSTSASSANIEEHGFESTTIDDILKAKGKSADGSWLWCTTEDSVYDAVQSMTQHNVGALVVVKPAEQNSIAGIITERDYLRKIIVQGRSSKSTKVGDIMTEENKLITVTPDTKVLRAMQLMTDNRIRHIPVIDDKGMKGMVSIGDVVRAVVSEHREELDRLNAYIQGGY

SEQ ID NO: 13970 - protein, 205 aa, Medicago truncatula
MQGGLRSFLSNGNVIKNAVLQRVRMVNPLLQPVAFSRFESATPARIEEHGFESTTISDILKGKGKGADGSWLWCTTDDTVYDAVKSMTQNNVGALVVVKPGEEKSIAGIITERDYLRKIIVQGRSSKSTKVGDIMTEENKLITVTPDTKVLRAMQLMTDNRIRHIPVINDKGMLGMVSIGDVVRAVVGEHRQELDRLNAYIQGGY

SEQ ID NO: 13971 - protein, 205 aa, Persea americana
MQGAIQAIRYHGNILKQAVVQHVRVVDPIMRSAIFSRFKSASSARLEEHGFESTTISDVLNSKGKGADGSWLWCTTDDTVYDAVKSMTQHNVGALVVVKPGEQKSIAGIITERDYLRKIIVQGRSSKSTKVGDIMTEENKLITVTPNTKVLRAMQLMTDNRIRHIPVINDKDMIGMVSIGDVVRAVVSEHREELDRLNAYIQGGY

SEQ ID NO: 13972 - protein, 204 aa, Cirsium arvense
MQGGLRAFVSHGSIVKNAVLQHVRLVNPLVRPLSRLESTSSAARIEEHGFESTTISDVLKGKGKGADGSWLWCTTDDSVYDAVQSMTQHNVGALVVVKPGEQSSIAGIITERDYLRKIIVQGRSSKSTKVGDIMTEENKLITVTPDTKVLKAMQLMTDNRIRHIPVIDDKKMLGMVSIGDVVRAVVSEHREELDRLNAFIQGGY

SEQ ID NO: 13973 - protein, 204 aa, Flaveria ramosissima
MQGGIRAFVSHGGIVKNAVLQHVRLVNPLRPLITSRHETTSAARIEEQGFESTKISDVLKAKGKGADGSWLWCTTDDSVYDAVKSMTQHNVGALVVVKPGEKSSIAGIITERDYLRKIIVQGRSSKSTKVGDIMTEENKLITVTPETKVLKAMQLMTDNRIRHIPVIDEKGMQGMVSIGDVVRAVVSEHREELNRLNTFIQGGY

SEQ ID NO: 13974 - protein, 205 aa, Carpinus betulus
MQGALQSFLSPGNIVKNSVLRHFRLVNPLMRSVLFSRFESVTSARMEEHGFESTTIADVLKAKGKSADGSWLWCTMDDTVYDAVKSMTHHNVGALVVVKPGEQKSIAGIITERDYLRKIIVQGRSSKSTKVGDIMTEENKLITVTPDTKVLRAMQLMTDNRIRHIPIIDGKGMIGMVSIGDVVRAVVSEHREELDRLNAYIQGGY

SEQ ID NO: 13975 - protein, 205 aa, Tabernaemontana elegans
MQGGIRAIFSHGNVLKNAILQHVRLAGPAMRPLMFARNESTSAARIEEHGFESTTISDILKAKGKSADGSWLWCTTEDTVYDAVKSMTQHNVGALVVVKPGEQKSIAGIITERDYLRKIIVQGRSSKSTKVGDIMTEENKLITVTPETKVLKAMQLMTDNRIRHIPVINDSGMVGMVSIGDVVRAVVSEHRDELNRLNAYIQGGY

SEQ ID NO: 13976 - protein, 168 aa, Cynara scolymus
MQGGFRAFVSHGSIVKNAVLQHVRLVNPLVRPLTRLESTSAARIEEHGFESTTISDVLKGKGKGADGSWLWCTTDDSVYDAVQSMTQHNVGALVVVKPGEQSSIAGIITERDYLRKIIVQGRSSKSTKVGDIMTEENKLITVTPDTKVLKAMQLMTDNRIRHIPVIDD

SEQ ID NO: 13977 - protein, 204 aa, Ambrosia trifida
MQGGIRAFVSNGSIVKNAVLQHVRLVNPLRPLMISRYESTSAARIEEQGFESTKISDVLNAKGKGADGSWLWCTTDDSVYDAVKSMTQHNVGALVVVKPGEKSSIAGIITERDYLRKIIVQGRSSKSTKVGDIMTEENKLITVTPETKVLKAMQLMTDNRIRHIPVIDEKGMQGMVSIGDVVRAVVSEHREELNRLNAFIQGGY

SEQ ID NO: 13978 - protein, 204 aa, Ambrosia trifida
MQGGIRAFVSNGSIVKNAVLQHVRQVNPLRPLMISRYESTSAARIEEQGFESTKISDVLNAKGKGADGSWLWCTTDDSVYDAVKSMTQHNVGALVVVKPGEKSSIAGIITERDYLRKIIVQGRSSKSTKVGDIMTEENKLITVTPETKVLKAMQLMTDNRIRHIPVIDEKGMQGMVSIGDVVRAVVSEHREELNRLNAFIQGGY

SEQ ID NO: 13979 - protein, 205 aa, Amsonia hubrichtii
MQGGIQAIFSHGNVLKNAILQHVRVVSPVMRSLMFARNESTSAATMEEHGFESTTISDILKAKGKSADGSWLWCTTEESVYDAVKSMTQHNVGALVVVKPGEQKSIAGIITERDYLRKIIVQGRSSKSTKVGDIMTEENKLITVRPDTKVLKAMELMTDNRIRHIPVINDSGMIGMVSIGDVVRAVVSEHRNELDRLNAYIQGGY

SEQ ID NO: 13980 - protein, 205 aa, Trifolium pratense
MQGALRSFLSNGSVIKNAVLQRVRVVNPLLQPAAFSRFESVTPARIEEHGFESTTISDILQGKGKGADGSWLWCTTDDTVYDAVKSMTQNNVGALVVVKPGEEKSIAGIITERDYLRKIIVQGRSSKSTKVGDIMTEENKLITVTPDTKVLRAMQLMTDNRIRHIPVINDKGMLGMVSIGDVVRAVVGEHRQELDRLNAYIQGGY

SEQ ID NO: 13981 - protein, 205 aa, Euonymus alatus
MQGSFRAFLSHTSIVKSSVLRHIRVMDPVLHPLVFSRSQSASSARMEEHGFESTTIADVLKAKGKSADGSWLWCTMSDTVYDAVKSMTQHNVGALVVVKPGEQKSIAGIITERDYLRKIIVQGRSSKSTKVGDIMTEENKLITVTPDTKVLRAMQLMTDNRIRHIPVIDKEGMVGMVSIGDVVRAVVSEHREELDRLNAYIQGGY

SEQ ID NO: 13982 - protein, 197 aa, Heritiera littoralis
AVGKLPYKNAVLQRIRVVNPVMRPIIFSRFESVSSARMEEHGFESTTIADILKAKGKGADGSWLWCTTDDTVYNAVKSMTQHNVGALVVVKPGEQKSIAGIITERDYLRKIILQGRSSKSTRVGDIMTEENKLITVTPETKVLRAMQLMTDNRIRHIPVIDEKGMVGMVSIGDVVRAVVTEHRVELDRLNAFIQGGY

SEQ ID NO: 13983 - protein, 205 aa, Rosa hybrid cultivar
MQGALKAFSSQGNFVKNAVLRHVRVVNPLIQPALFSRFESTAPARIEEQGFESTRIADILNSKGKGADGSWLWCTTDDSVYDAVKSMTQHNVGALVVVKPGEQKSIAGIITERDYLRKIIVQGRSSKSTKVGDIMTEENKLITVTPDTKVLRAMQLMTDNRIRHIPVIDDRGMLGMVSIGDVVRAVVSEHREELDRLNAFIQGGY

SEQ ID NO: 13984 - protein, 203 aa, Cirsium arvense
MQGGLRAFVSHGSIVKNAVLQHIRLVSPLVRPLTRHESTSAARIEEHGFESTTISDVLKGKGKGADGSWLWCTTDDTVYDAVQSMTQHNVGALVVVKPGEQSAIAGIITERDYLRKIIVQGRSSKSTKVGDIMTEENKLITVTPDTKVLKAMQLMTDNRIRHIPVIDEKKMLGMVSIGDVVRAVVSEHREELDRLNAFIQGGY

SEQ ID NO: 13985 - protein, 203 aa, Carthamus tinctorius
MQGGLRAFVSHGSIVKNAVLQHVRLVSPLVRPLTRHESTSAARIEEHGFESTTISDVLKGKGKGADGSWLWCTTDDTVYDAVQSMTQHNVGALVVVKPGEQSSIAGIITERDYLRKIIVQGRSSKSTKVGDIMTEENKLITVTPDTKVLKAMQLMTDNRIRHIPVIDEKKMLGMVSIGDVVRAVVSEHREELDRLNAFIQGGY

SEQ ID NO: 13986 - protein, 206 aa, Lupinus angustifolius
MLGGLRVFLSHGNVIKNAVLQQVRMVNPLLQPVAFSRFESVKSARIEEHGFESTTIADILKGKGKGADGSWLWCTTDDTVYDAVKSMTQNNVGALVVVKPGGEQKSIAGIITERDYLRKIIVQGRSSKSTKVGDIMTEENKLITVSPDTKVLRAMQLMTDNRIRHIPVINDKGMIGMVSIGDVVRAVVSEHRQELDRLNAYIQGGY

SEQ ID NO: 13987 - protein, 206 aa, Lupinus angustifolius
MLGGLRVFLSHGNVIKNAVLQRVRMVNPLLQPVAFSRFESVTPARIEEHGFESTTIADILKGKGKGADGSWLWCTTDDTVYNAVKSMTQNNVGALVVVKPGGEQKSIAGIITERDYLRKIIVQGRSSKSTKVGDIMTEENKLITVSPDTKVLRAMQLMTDNRIRHIPVINDKGMIGMVSIGDVVRAVVSEHRQELDRLNAYIQGGY

SEQ ID NO: 13988 - protein, 207 aa, Malus domestica
MQGALKAFTSHGSIVKNGVLRHIRLVNPLLQPVAFSRFESATPASSRIEEHGFESTRIADVLKGKGKGADGSWLWCTTDDSVYDAVKSMTQHNVGALVVVKPGVQKSLAGIITERDYLRKIIVQGRSSKSTKVGDIMTEENKLITVTPDTKVLRAMQLMTDNRIRHIPVIDNGGMIGMVSIGDVVRAVVSEHREELDRLNAFIQGGY

SEQ ID NO: 13989 - protein, 206 aa, Ricinus communis
MNRAVNAFLSRGNLIKNAVLQHARVVANPGLRPIVFSRFESVSSARMEEQSFESTTIADVLKGKGKSADGSWLWCTTEDTVYDAVKSMTHHNVGALVVVKPGEQKSIAGIITERDYLRKIIVQGRSSKSTKVGDIMTEENKLITVTPDTKVLRAMQLMTDNRIRHIPVINDKDMVGMLSIGDVVRAVVAEHREELERLNAYIQGGY

SEQ ID NO: 13990 - protein, 205 aa, Eschscholzia californica
MQGAIQAIRSHGNIFKNVILQHVRLVGPSTTHARPAAAAMFSSTRLEEHGFESTTILDVLKAKGKNADGSWLWCTTDDSVYDAVKSMTQHNVGALVVVKPGEQKSLAGIITERDYLRKIIVQGRSSKSTKVGDIMTEENKLITVTPDTKVLRAMQLMTDNRIRHIPVINEKEMVGMVSIGDVVRAVVSEHREELDRLNAFIQGGY

SEQ ID NO: 13991 - protein, 206 aa, Eutrema parvulum
MQAALRSFVVGGNVVKASMLQHLRVINPAIHPSVFCSRSESTQPARMEEHGFESTTISDIMNAKGKGADGSWLWCTTDDTVYDAVKSMTQHNVGALVVVKPGEQQSLAGIITERDYLRKIIVQGRSSKSTKVGDIMTEENKLITVTPETKVLRAMQLMTDNRIRHIPVIKEKGMVGMVSIGDVVRAVVTEHREELNRLNAFIQGGY

SEQ ID NO: 13992 - protein, 204 aa, Arnica chamissonis
MQGGIRAFVSHGSIVKNAVLQHVRLVNPLRPLIMSRHESTAAARIEEQGFESTKISDVLKAKGEGADGSWLWCTTDDSVYDAVKSMTQHNVGALVVVKPGEKSSIAGIITERDYLRKIIVQGRSSKSTKVGDIMTEENKLITVTPGTKVLKAMQLMTDNRIRHIPVIDEKGMQGMVSIGDVVRAVVSEHREELNRLNAFIQGGY

SEQ ID NO: 13993 - protein, 205 aa, Vaccinium corymbosum
MQGGIQKVLSHGGVLKNAVLQHIRLVNPVARPLLFPRYESVASARMEEHGFESTTISDILKAKGKSADGSWLWCATEDTVYDAVKSMTQHNVGALVVVKPGEQKSIAGIITERDYLRKIIVQGRSSKSTKVGDIMTEENKLITVTPDTKVLKAMQLMTDNRIRHIPVIDDKEMIGMVSIGDVVRAVVSEHREELDRLNAFIHGGY

SEQ ID NO: 13994 - protein, 204 aa, Cichorium intybus
MQGGIRALVSQGSIVKQAVLQHVRLVNPLRPLMLSRYESTSAARIEEHGFESTTISDILKGKGKGADGSWLWCTTDDSVYDAVKSMTQHNVGALVVVKPGEQSSIAGIITERDYLRKIIVQGRSSKSTKVGDIMTEENKLITVTPDTKVLKAMQLMTDNRIRHIPVINDKVMLGMVSIGDVVRAVVSEHREELNRLNAFIQGGY

SEQ ID NO: 13995 - protein, 204 aa, Flaveria ramosissima
MQGGIRAFVSHGSIVKNAVLQHVRLVNPLRPLIMSRHESTSAARIEEQGFESTKISDVLKAKGKGADGSWLWCTTDDSVYDAVKSMTQHNVGALVVVKPGEKSSIAGIITERDYLRKIIVQGRSSKSTKVGDIMTEENKLITVTPDTKVLKAMQLMTDNRIRHIPVIDEKGMQGMVSIGDVVRAVVSEHREELNRLNSFIQGGY

SEQ ID NO: 13996 - protein, 205 aa, Ipomoea batatas
MQRGFQALFSQGNVLKAAVLRQIRLGNPAMRPLMFACRESTSAARIEEHGFESTTISDVLKSKGEGADGSWLWCTTDDSVYDAVKSMTHHNVGALVVVKPGEQKSIAGIITERDYLRKIIVQGRSSKSTKVGDIMTEENKLITVAPQTKVLKAMQLMTDNRIRHIPVIDDSGMVGMVSIGDVVRAVVTEHRVELDRLNAYIQGGY

SEQ ID NO: 13997 - protein, 204 aa, Parthenium argentatum
MQGGIRAFVSNGNIVKNAVLQHVRLVNPLRPLLISRHESTSAARIEEQGFESTKISDVLNAKGKGADGSWLWCTTDDSVYDAVKSMTQHNVGALVVVKPGEKSSIAGIITERDYLRKIIVQGRSSKSTKVGDIMTEENKLITVTPDTKVLKAMQLMTDNRIRHIPVIDEKGMQGMVSIGDVVRAVVSEHREELNRLNAFIQGGY

SEQ ID NO: 13998 - protein, 172 aa, Ambrosia trifida
MISRYESTSAARIEEQGFESTKISDVLNAKGKGADGSWLWCTTDDSVYDAVKSMTQHNVGALVVVKPGEKSSIAGIITERDYLRKIIVQGRSSKSTKVGDIMTEENKLITVTPETKVLKAMQLMTDNRIRHIPVIDEKGMQGMVSIGDVVRAVVSEHREELNRLNAFIQGGY

SEQ ID NO: 13999 - protein, 168 aa, Flaveria ramosissima
MSQLQRLVLKNKVLKAQRISDVLKAKGKGADGSWLWCTTDDSVYDAVKSMTQHNVGALVVVKPGEKSSVAGIITERDYLRKIIVQGRSSKSTKVGDIMTEENKLITVTPDTKVLKAMQLMTDNRIRHIPVIDEKGMQGMVSIGDVVRAVVSEHREELNRLNSFIQGGY

SEQ ID NO: 14000 - protein, 195 aa, Guizotia abyssinica
MQGGIRAFVSRGSIVKNAVLQHVRLVNPLKPLMISRHESTAAARIEEQGFESTKISDVLKAKGKGADGSWLWCTTDDSVYDAVKSMTQHNVGALVVVKPGEKSSIAGIITERDYLRKIIVQGRSSKSTKVGDIMTEENKLITVTPETKVLKAMQLMTDNRIRHIPVIDEKGMQGMVSIGDVVRAVVSEHREELNV

SEQ ID NO: 14001 - protein, 86 aa, Carpinus betulus
MQGALQSFLSPGSIVKNSVLQHFRLVNPLMRSVLFSRFESVTSARMEEHGFESTTIADVLKAKGKVLMALGSGALWMIQFTMRLSR

SEQ ID NO: 14002 - protein, 203 aa, Centaurea maculosa
MQGGLRAFVSHGSIVKNAVLQHVRLVSPLVRPLTRHESTSAARIEEHGFESTTISDILKGKGKGADGSWLWCTTDDTVYDAVQSMTQHNVGALVVVKPGEQSSIAGIITERDYLRKIIVQGRSSKSTKVGDIMTEENKLITVTPDTKVLKAMQLMTDNRIRHIPVIDEKKMLGMVSIGDVVRAVVSEHREELDRLNAFIQGGY

SEQ ID NO: 14003 - protein, 203 aa, Centaurea maculosa
MQGGLRAFVSHGSIVKNAVLQHVRLVSPLVRPLTRHESTSAARIEEHGFESTTISDVLKGKGKGADGSWLWCTTDDTVYDAVQSMTQHNVGALVVVKPGEQSSIAGIITERDYLRKIIVQGRSSKSTKVGDIMTEENKLITVTPDTKVLKAMQLMTDNRIRHIPVIDEKKMLGMVSIGDVVRAVVSEHREELNRLNAFIQGGY

SEQ ID NO: 14004 - protein, 203 aa, Artemisia annua
MQRGIGAFVSHGSIVKNAVLQHIRLVNPLARVLVRHESTSAARMEEHGFESAKISDILKGKGKSADGSWLWCTTEDSVYDAVKSMTQHNVGALVVVKPGEEKSIAGIITERDYLRKIIVQGRSSKSTKVGDIMTEENKLITVTPDTKVLKAMQLMTDNRIRHIPVIDEKGMLGMVSIGDVVRAVVSEHREELDRLNAFIQGGY

SEQ ID NO: 14005 - protein, 207 aa, Eschscholzia californica
MQGAIQAIRSHGNIFKNVILQHVRLVGPSTTHARPTAAAAAMFSSTRLEEHGFESTTILDVLKAKGKNADGSWLWCTTDDSVYDAVKSMTQHNVGALVVVKPGEQKSLAGIITERDYLRKIIVQGRSSKSTKVGDIMTEENKLITVTPDTKVLRAMQLMTDNRIRHIPVINEKEMVGMVSIGDVVRAVVSEHREELDRLNAFIQGGY

SEQ ID NO: 14006 - protein, 207 aa, Lactuca sativa
MQGGIRSLVSHGSLVKQAVLQHVRVMKVNPLQSLMLSRHESTSAAPRMEEHGFESTTISDILKGKGKGADGSWLWCTTDDSVYDAVKSMTQHNVGALVVVKPGEQSSIAGIITERDYLRKIIVQGRSSKSTKVGDIMTEENKLITVTPDTKVLKAMQLMTDNRIRHIPVISEKEMLGMVSIGDVVRAVVSEHREELNRLNAFIQGGY

SEQ ID NO: 14007 - protein, 206 aa, Cucurbita pepo
MQGAVRSFLSHGNIVKTAVLQQLRVANPCMRPAMLSRFTTSTSSANIEEHGFESTTIDDILKAKGKSADGSWLWCTTDDTVYDAVQSMTQHNVGALVVVKPAEQNSIAGIITERDYLRKIIVQGRSSKSTKVGDIMTEENKLITVTPDTKVLRAMQLMTDNRIRHIPVIDDKGMKGMVSIGDVVRAVVSEHREELNRLNAFIQGGY

SEQ ID NO: 14008 - protein, 206 aa, Cucurbita pepo
MQGAVRSFLSHGNVVKTAVLQQIRLANPQMRPAMFSCFTTSANSANIEEHGFESTTIDDILKAKGKSADGSWLWCTTDDTVYDAVQSMTQHNVGALVVVKPAEQNSIAGIITERDYLRKIIVQGRSSKSTKVGDIMTEENKLITVTPDTKVLRAMQLMTDNRIRHIPVIDDKGMKGMVSIGDVVRAVVSEHREELNRLNAFIQGGY

SEQ ID NO: 14009 - protein, 106 aa, Momordica charantia
MQGALRSFLSNGSIVKNAVLQQIRVASPHMRPAIVSRFASSASSASIEEHGFESTTIDDILKAKGKGADGSWLWCTTDDTVYDAVQSMTQHNVGALVVVKPGAKIQ

SEQ ID NO: 14010 - protein, 205 aa, Panax ginseng
MQGGFRAILSNGSILKNAVLERVRLVNPVMRPLLFSRHESVSSARIEEHGFESTTISDILKGKGKSADGSWLWCTTDDSVYDAVKSMTQHNVGALVVVKPGEQKAIAGIITERDYLRKIIVQGRSSKSTKVGDIMTEENKLITVSPATKVLKAMQLMTDNRIRHIPVVDDKGMIGMVSIGDVVRAVVSEHRDELNRLNAFIQGGY

SEQ ID NO: 14011 - protein, 205 aa, Panax ginseng
MQGGFRAILSNGSILKNAVLQRVRLVNPVMRPLLFSRHESVSSARIEEHGFESTTISDILKGKGKSADGSWLWCTTDDSVYDAVKSMTQHNVGALVVVKPGEQKAIAGIITERDYLRKIIVQGRSSKSTKVGDIMTEENKLITVSPATKVLKAMQLMTDNRIRHIPVVDDKGMIGMVSIGDVVRAVVSEHRDELNRLNAFIQGGY

SEQ ID NO: 14012 - protein, 205 aa, Acacia harpophylla
MQGGLRSFLSHGSVIKNSVLQRVRMVNPLLQPVTFSRFESASPARMEEHGFESTTIADILKSKGKGADGSWLWCTTGDTVYDAVKSMTQHNVGALVVVKPGEEKAIAGIITERDYLRKIIVQGRSSKSTKVGDIMTEENKLITVTPDTKVLRAMQLMTDNRIRHIPVINDKGMMGMVSIGDVVRAVVSEHRQELDRLNAFIQGGY

SEQ ID NO: 14013 - protein, 205 aa, Coffea canephora
MQGGIHAIVSHGNILRNAILQHVRVVSPVMRSLVFARHESTSAAQMEEHGFESTKISDVLKAKGKGADGSWLWCTTDDTVYDAVKSMTNHNVGALVVVKPKEQNAIAGIITERDYLRKIIVQGRSSKSTKVGDIMTEENKLITVTPDTKVLKAMQLMTDNRIRHIPVVDNKGMVGMVSIGDVVRAVVSEHRDELDRLNAYIQGGY

SEQ ID NO: 14014 - protein, 204 aa, Flaveria ramosissima
MQGGLRAFVSHGSIVRNAVLQHVRLVNPLRPLIISRHEATSAARIEEQGFESTKIADVLKAKGKGADGSWLWCTTDDSVYDAVKSMTQHNVGALVVVKPGEKSSIAGIITERDYLRKIIVQGRSSKSTKVGDIMTEENKLITVTPDTKVLKAMQLMTDNRIRHIPVIDDKGMQGMVSIGDVVRAVVSEHREELNRLNAFIQGGY

SEQ ID NO: 14015 - protein, 205 aa, Humulus lupulus
MQGVIRGFLSNGNVVKNAVLQRISLVNPVLQPAILSRFQSTTTARIEEHGFESTTISDIMKSKGKGADGSWLWCTTDDSVYEAVKSMTQHNVGALVVVKPGEEKSIAGIITERDYLRKIIVQGRSSKSTKVGDIMTEENKLITVNPSTKVLRAMQLMTDNRIRHIPVVDDKGMIGMVSIGDVVRAVVSEHRQELDRLNAFIQGGY

SEQ ID NO: 14016 - protein, 203 aa, Platanus occidentalis
MQGAVQAIHSHGNILKRAVLQHVRLLNPVLQPALFSRFASVSSPRLEEHGFESTTIVDILKAKGKSADGSWLWCMTDDTVYDAVKSMTQHNVGALVVVKPGEQKSIAGIITERDYLRKIIVQGRSSKSTKVGDIMTEENKLITVTPNTKVLRAMQLMTDNRIRHIPVIDGKEMIGMVSIGDVVRAVVSEHREELDRLNAYIQG

SEQ ID NO: 14017 - protein, 205 aa, Populus trichocarpa
MQGALRTCLTHGNVVKDSLLQHVRVLSPLLRPIVFSRFESVSSARIEEHGFESTRIADILKEKGKGADGSWLWCTTDDTVYDAVKSMTQHNVGALVVVKPGEQKSIAGIITERDYLRKIIVQGRSSKSTKVGDIMTEENKLITVTPDTKVLKAMQLMTDKRIRHIPVIDDKEMIGMVSIGDVVRAVVSEHREEVDRLNAYIQGGY

SEQ ID NO: 14018 - protein, 204 aa, Helianthus annuus
MQGGIRAFVSHGSIVKNAVLQHARLVNPLKPLLISRYESTSAARIEEQGFESTKISDVLQAKGKGADGSWLWCTTDDSVYDAVKSMTQHNVGALVVVKPGEKSSIAGIITERDYLRKIIVQGRSSKSTKVGDIMTEENKLITVTPDTKVLKAMQLMTDNRIRHIPVIDEKGMQGMVSIGDVVRAVVSEHREELNRLNAFIQGGY

SEQ ID NO: 14019 - protein, 204 aa, Tragopogon dubius
MQGGIRALVSHGSIVKNAVLQHVRLVNPLRPLILSRHESTSAARIEEHGFESTTISDVLKGKGKGADGSWLWCTTDDTVYDAVKSMTQHNVGALVVVKPGEQSSVAGIITERDYLRKIIVQGRSSKSTKVGDIMTEENKLITVTPDTKVLKAMQLMTDNRIRHIPVISDKGMLGMVSIGDVVRAVVSEHRDELNRLNAFIQGGY

SEQ ID NO: 14020 - protein, 205 aa, Trigonella foenum-graecum
MQGGLRSFLSNGNIIKNAVLQRVRMVNPLLQPVAFSRFESATPARIEEHGFESTTISDILQGKGEGADGSWLWCTTDDTVYDAVKSMTQNNVGALVVVKPGEEKSIAGIITERDYLRKIIVQGRSSKSTKVGDIMTEENKLITVTPDTKVLRAMQLMTDNRIRHIPVINDKGMLGMLSIGDVVRAVVGEHRQELDRLNAYIQGGY

SEQ ID NO: 14021 - protein, 202 aa, Eucalyptus grandis
MQGIPIVFIESKLDQKCSSETHPSGNPQIVSFSRFMSVSSARIEEHGFESTTIADVLKAKGKSADGSWLWCTTDDTVYDAVKSMTQHNVGALVVVKPGEQKSIAGIITERDYLRKIIVQGRSSKSTKVGDIMTEENKLITVTPDTKVLKAMQLMTDNRIRHIPVINEAGMAGMVSIGDVVRAVVSEHREELDRLNAYIQGGY

SEQ ID NO: 14022 - protein, 76 aa, Fraxinus spp
MQGGIQAIFSHGNVLKNAVLKHVRLVTPAMRPLMFVRHETVSAAHIEEHGFESTKISDILKAKGKNADGVLALVHN

SEQ ID NO: 14023 - protein, 203 aa, Flaveria ramosissima
MQRAIGSFISNGSIVKNAVLQHIRLVNPLAQTLVRHESTSAARMEEHGFEKTIISDILKSKGKSADGSWLWCTTEDSVYDAVKSMTQHNVGALVVVKPGEEKSIAGIITERDYLRKIIVQGRSSKSTKVGDIMTEENKLITVTPDTKVLKAMQLMTDNRIRHIPVIGEKGMVGMVSIGDVVRAVVSEHREELNRLNAYIQGGY

SEQ ID NO: 14024 - protein, 74 aa, Centaurea maculosa
MQGGLRAFVSNGSIVKNAVLQHVRLVSPLVRPLTRHESTSAARIEEHGFESTTISDVLKGKGKGCRWLLALVHH

SEQ ID NO: 14025 - protein, 176 aa, Cirsium arvense
MQGGLRAFVSHGSIVKNAVLQHVRLVSPLVRPLTRHESTSAARIEEHGFESTTISDILKGKGKGADGSWLWCTTDDTVYDAVQSMTQHNVGALVVVKPGEQSSIAGIITERDYLRKIIVQGRSSKSTKVGDIMTEENKLITVTPDTKVLKAMQLMTDNRIRHIPVIDEKKCWGWFP

SEQ ID NO: 14026 - protein, 140 aa, Hevea brasiliensis
GNFVKSAVLQRFRVANPLLRPIMFSRFDSVSSARMEEQSFESTTISDILKAKGKGADGSWLWCTTDDTVYDAVKSMTLHNVGALVVLKPGEQKSIAGIITERDYLRKIIVQGRSSKSTKVGDIMTEEVTAEQAYYSHSRH

SEQ ID NO: 14027 - protein, 207 aa, Brassica rapa
MQAAIRSFVSGGNVVKASLLQHLRVINPAIQPSSVFCTRSESTQTSRMEEHGFESTTISDVMKAKGKSADGSWLWCTTDDTVYDAVKSMTQHNVGALVVVKPGEQQSLAGIITERDYLRKIIVQGRSSKSTKVGDIMTEENKLITVTPETKVLRAMQLMTDNRIRHIPVIKDKGMVGMVSIGDVVRAVVTEHREELNRLNAFIQGGY

SEQ ID NO: 14028 - protein, 207 aa, Linum usitatissimum
MQGAIGAFFSKAGVVKTGVLQHVRVLNPALRPLVFSRSESSVSSAARIEEHGFEHTTISDVLSAKGKGADGSWLWCTTDDTVYDAVHSMTQHNVGALVVVKPGEQKSIAGIITERDYLRKIIVQGRSSKSTKVGDIMTEENKLITVTPDTKVLVAMQLMTDNRIRHIPVIDEKGMSGMVSIGDVVRAVVREHREELDRLNAYIQGGY

SEQ ID NO: 14029 - protein, 206 aa, Brassica napus
MQAAIRSFVSGGNVVRASLLQHLRVINPASQPSVFGSRSESTQPSRMEEHGFESTTISDVMKAKGKSADGSWLWCTTDDTVYDAVKSMTQHNVGALVVVKPGEQQSLTGIITERDYLRKIIVQGRSSKSTKVGDIMTEENKLITVTPETKVLRAMQLMTDNRIRHIPVIKDKGMVGMVSIGDVVRAVVTEHREELDRLNAFIQGGY

SEQ ID NO: 14030 - protein, 206 aa, Raphanus sativus
MQAAIRSFVSGGNVVKASLLQHVRVINPAIQPSVFCKRSDSTQSSRMEEHGFESTTISDVMNAKGKSADGSWLWCTTDDSVYDAVKSMTQHNVGALVVVKPGEQQSLAGIITERDYLRKIIVQGRSSKSTKVGDIMTEENKLITVTPETKVLRAMQLMTDNRIRHIPVIKDKGMVGMVSIGDVVRAVVTEHREELNRLNAFIQGGY

SEQ ID NO: 14031 - protein, 206 aa, Raphanus sativus
MQAAIRSFVSGGNVVKASLLQHVRVINPAIQPSVFCKRSESTQSSRMEEHGFESTTISDVMNAKGKSADGSWLWCTTDDSVYDAVKSMTQHNVGALVVVKPGEQQSLAGIITERDYLRKIIVQGRSSKSTKVGDIMTEENKLITVTPETKVLRAMQLMTDNRIRHIPVIKDKGMVGMVSIGDVVRAVVTEHREELNRLNAFIQGGY

SEQ ID NO: 14032 - protein, 206 aa, Eutrema halophilum
MQAAIRSFVSGGNVVKASLLQHLRVMNPAIQPSVFCTRSESTQSARMEEHGFESTTISDIMNAKGKSADGSWLWCTTDDTVYDAVKSMTQHNVGALVVVKPGEQQSLAGIITERDYLRKIIVQGRSSKSTKVGDIMTEENKLITVTPETKVLRAMQLMTDNRIRHIPVIKDTGMVGMVSIGDVVRAVVSEHREELDRLNAFIQGGY

SEQ ID NO: 14033 - protein, 205 aa, Musa acuminata
MQGALRSLRLHGNVIKNAMLQHIRVMNPATLPTVFSRFESVSSARLEEHGFESTTIRDIMKAKGKSADGSWLWCTTDDSVYDAVKSMTQHNVGALVVVKPGEDKAIAGIVTERDYLRKIIVQGRSSKSTKVGDIMTEENKLITVTPDTKVLRAMQLMTDNRIRHIPVIDNNGMIGMVSIGDVVRAVVSEHREELNRLNAYIQGGY

SEQ ID NO: 14034 - protein, 205 aa, Cannabis sativa
MQGVIRGFFSNGNVVKNAVLQRISLVNPVLQPAILSRFQGTTTARIEEHGFESTTISDIMKSKGKGADGSWLWCTTDDTVYEAVKSMTQHNVGALVVVKPGEEKSIAGIITERDYLRKIIVQGRSSKSTKVGDIMTEENKLITVNPSTKVLRAMQLMTDNRIRHIPVIDDKGMIGMVSIGDVVRAVVSEHRQELDRLNAFIQGGY

SEQ ID NO: 14035 - protein, 205 aa, Cicer arietinum
MQGGLRSFLSNGNIIKNAVLQRVRMVTPLLQPAAFSRFESVTPARIEEHGFESATISDILQGKGKGADGSWLWCTTDETVYDAVKSMTQNNVGALVVVKPGEQNTIAGIITERDYLRKIIVQGRSSKSTKVGDIMTEENKLITVTPDTKVLRAMQLMTDNRIRHIPVINEKGMIGMVSIGDVVRAVVSEHRQELDRLNAYIQGGY

SEQ ID NO: 14036 - protein, 199 aa, Euphorbia peplus
RFLSRGNVIKTAVLQCVRVANPLLRPVFFSRFESGSSASMEEQSFESTTISDILKAKGKSADGSWLWCTTEDTVYDAVKSMTQHNVGALVVVKPGEEKSLAGIITERDYLRKIIVQGRSSKSTKVGDIMTEENKLITVTPKTKVLQAMQLMTDNRIRHIPVINDKDMIGMVSIGDVVRAVVIEHREELDRLNAYIQGGY

SEQ ID NO: 14037 - protein, 195 aa, Hevea brasiliensis
MQGAVNAFLSHGNLVKNAVLQRFRVANPVLRPILFSRFESVLSAGMEEQSFESTTISDILKTKGKGADGSWLWCTTDDTVYDAVKSMTQHNVGALVVVKPGEQKSIAGIITERDYLRKIIVQGRSSKSTKVGDIMTEENKLITVTPDTKVLQAMQLMTDKRIRHIPVIDDKEMIGMVSIGDVVRAVVTEHREELD

SEQ ID NO: 14038 - protein, 204 aa, Capsicum annuum
MQGGFKLFSRGSVLKSAVLRHVRLVNPVSRPLMFVRCETTSAARIEEHGFESTKISDILKGKGKGADGSWLWCTTDDSVYDAVKSMTQHNVGALVVVKSGENKSIAGIITERDYLRKIIVQGRSSKSTKVGDIMTEENKLITVTPETKVLKAMQLMTDNRIRHIPVIDQTGMIGMVSIGDVVRAVVSEHREELNRLNAFIQGGY

SEQ ID NO: 14039 - protein, 205 aa, Salvia sclarea
MQGGIHAILSNGNVLKNAVLQHVRVVPPAMRALMYSRHESTSAARIEEHGFESTKIADVLTAKGKGADGSWLWCTTDDSVYDAVKSMTQHNVGALVVVKPGEQKSIAGIITERDYLRKIIVQGRSSKSTKVGDIMTEENKLITVTPDTKVLKAMQLMTDNRIRHIPVVNDGGMIGMVSIGDVVRAVVSEHREELNRLNAYIQGGY

SEQ ID NO: 14040 - protein, 204 aa, Helianthus annuus
MQGGIRAFVSQGSIVKNAVLQHARLVNPLKPLLISRYESTSAARIEEQGFESTKISDVLQAKGKGADGSWLWCTTDDSVYDAVKSMTQHNVGALVVVKPGEKSSIAGIITERDYLRKIIVQGRSSKSTKVGDIMTEENKLITVTPDTKVLKAMQLMTDNRIRHIPVIDEKGMQGMVSIGDVVRAVVSEHREELNRLNAFIQGGY

SEQ ID NO: 14041 - protein, 85 aa, Ambrosia trifida
MQGGIKAFVSNGSIVKNAVLQHVRLVNPLRPLMVSRYESTSAARIEEQGFESTKISDVLNAKGKVQMVHGYGAPLMTRCMMLSNR

SEQ ID NO: 14042 - protein, 211 aa, Liriodendron tulipifera
MQGAIQAIRSHGNILRQAVLQHVRILGPVMRPAMFSRFESVSSARLEEHGFESTTISDILKGKGKSADGSWLWCTIEDTVYDAVKAMTQHNVGALVVVKPGEQKSIAGIITERDYLRKIIVQGRSSKSTKVGDIMTEENKLITVTPDTKVLRAMQLMTDNRIRHIPVIDDKEMIGMVSIGDVVRAVVSEHREELDRLNAYIQGGLLGIWTC

SEQ ID NO: 14043 - protein, 204 aa, Papaver somniferum
MQGAMQAIRSHGSVFKSAILQHIRIVDPALRPAFSTRFQSTAPRLEEHGFESTTISDVLKAKGKSADGSWLWCTIDDSVYDAVKSMTQHNVGALVVVKPGEQKSLAGIITERDYLRKIIVQGRSSKSTKVGDIMTEENKLITVTPDTKVLRAMQLMTENRIRHIPVISGKDMIGMVSIGDVVRAVVSEHREELDRLNAFIQGGY

SEQ ID NO: 14044 - protein, 203 aa, Ambrosia trifida
MQRAIGSFVSHGSIVKNAVLQHVRLVNPLAQTLVRHESASAARMEEHGFEKTQISDVLKSKGKSADGSWLWCTTEDSVYEAVKSMTQHNVGALVVVKPGEEKSIAGIITERDYLRKIIVQGRSSKSTKVGDIMTEENKLITVTPDTKVLKAMQLMTDNRIRHIPVIGEKGMLGMVSIGDVVRAVVSEHREELDRLNAFIQGGY

SEQ ID NO: 14045 - protein, 203 aa, Arnica chamissonis
MQRAVGSFISHGSIVKNTVLQHIRLVNPLAQTLVRHNSASAARIEEHGFEKTIISDVLKSKGKSADGSWLWCTTEDSVYDAVKSMTQHNVGALVVVKPGEEKSVAGIITERDYLRKIIVQGRSSKSTKVGDIMTEENKLITVTPDTKVLKAMQLMTDNRIRHIPVIGEKGMLGMVSIGDVVRAVVGEHREELDRLNAYIQGGY

SEQ ID NO: 14046 - protein, 203 aa, Conyza canadensis
MQRSIGTFLSHGSVVKNAVLQHIRLVNPLARSLVRHESTSAARIEEQGFESTKISDVLKGKGKSADGSWLWCTTEDSVYDAVKSMTQHNVGALVVVKPGEEKSIAGIITERDYLRKIIVQGRSSKSTKVGDIMTEENKLITVTPDTKVLKAMQLMTDNRIRHIPVIDEKGMLGMVSIGDVVRAVVSEHREELNRLNAFIQGGY

SEQ ID NO: 14047 - protein, 203 aa, Flaveria ramosissima
MQRAIGSFISNGSIVKNAVLQHIRLVNPLAQALVRHESTSAARMEEHGFEKTIISDILKLKGKSADGSWLWCTTEDSVYDAVKSMTQHNVGALVVVKPGEEKSIAGIITERDYLRKIIVQGRSSKSTKVGDIMTEENKLITVTPDTKVLKAMQLMTDNRIRHIPVIGEKGMLGMVSIGDVVRAVVSEHREELNRLNAYIQGGY

SEQ ID NO: 14048 - protein, 207 aa, Arachis hypogaea
MQGGFRSILSHGNVVKSAILQRMRMVNSPQLQPLVLKRFESSAAPARMEEHGFESTTISDILKVKGKSADGSWLWCTTNDSVYDAVQSMTQHNVGALVVVKSDEQKSIAGIITERDYLRKIIVQGRSSKSTKVGDIMTEENKLITVTPDTKVLKAMQLMTDNRIRHIPVINDKGMIGMVSIGDVVRAVVSEHRQELDRLNAYIQGGY

SEQ ID NO: 14049 - protein, 207 aa, Euphorbia peplus
MQGAVNAFFSHGSLIKNAVLQRVRVVSPVLRPLVFSRFESVSPARMDEQSFESTTISDILKAKGKSADGSWLWCTTEDTVYDAVQSMTQHNVGALMVVKPGEQEQKSLAGIITERDYLRKIIVQGRSSKSTKVGDIMTEENKLITVTPNTKVLQAMQLMTDRRIRHIPVVNDKDMIGMVSIGDVVRAVVTEHREELDRLNAYIQGGY

SEQ ID NO: 14050 - protein, 206 aa, Eutrema parvulum
MQAAIRSFVSGGNVVKASLLQHLRVMNPAIQPSVFCTRSESTQSARMEEHGFESTTISDIMNAKGKSADGSWLWCTTDDTVYDAVKSMTQHNVGALVVVKPGEQQSLAGIITERDYLRKIIVQGRSSKSTKVGDIMTEENKLITVTPETKVLRAMQLMTDNRIRHIPVIKDTGMVGMVSIGDVVRAVVSEHREELNRLNAFIQGGY

SEQ ID NO: 14051 - protein, 206 aa, Amborella trichopoda
MQGAIQSLRSHGSILKRAVLQHIRVIPDSVTRPSPRFFSAPSSSSRLEEHGFESTTISDVLKGKGKSADGSWLWCTTDDTVYDAVQSMTQHNVGALVVVKPGEQKSIAGIITERDYLRKIIVQGRSSKSTKVGDIMTEENKLITVTPDTKVLRAMQLMTDNRIRHIPVIDGKDMVGMVSIGDVVRAVVSEHRDELDRLNAYIQGGY

SEQ ID NO: 14052 - protein, 203 aa, Aquilegia formosa
MQGATQAIRFHANILKHSILQRIRLAATPPLFHHIQSFSSAARIEEHGFESTTISDVLNAKGKSADGSWLWCTTDDTVYDAVKSMTQHNVGALVVVKPGEQYSIAGIITERDYLRKIIVQGRSSKSTKVGDIMTEENKLITVTPDTKVLRAMQLMTDNRIRHIPVINEKKMIGMVSIGDVVRAVVSEHREELDRLNAFIQGGY

SEQ ID NO: 14053 - protein, 206 aa, Brassica juncea
MQAAIRSFVSGGNVVRASLLQHLRVVNPAIQPSVFCRRSESTQSSRMEEHGFESTTISDVMNAKGKSADGSWLWCTTDDTVYDAVKSMTQHNVGALVVVKPGEQQSLAGIITERDYLRKIIVQGRSSKSTKVGDIMTEENKLITVTPETKVLRAMQLMTDNRIRHIPVIKDKGMVGMVSIGDVVRAVVTEHREELNRLNAFIQGGY

SEQ ID NO: 14054 - protein, 86 aa, Fagus grandifolia
MQGALRSYLSNGSIVKKAVLQHFRPLTPLMQPVMFSRFESVTSARMEEHGFESTTIADVLKEKGKKLMDPGFGALRMTVFMRLLSR

SEQ ID NO: 14055 - protein, 132 aa, Eucalyptus grandis
MQGIQSFSLKASLIKSAVLKHIRLANPQIVSFSRFMSVSSARIEEHGFESTTIADVLKAKGKSADGSWLWCTTDDTVYDAVKSMTQHNVGALVVVKLENRKSYCWKLSQREITSGRLSYREDHQNRPRLETS

SEQ ID NO: 14056 - protein, 205 aa, Fagopyrum esculentum
MQGAIGSFLLHGRSIKNAVSRHLNVASPLLRPAMFTRFESTMSARMEEHGFESTTISDIMKGKGEGADGSWLWCTTDDSVYDAVKSMTQHNVGALVVVKPKEQNSIAGIITERDYLRKIIVQGRSSKSTKVGDIMTEENKLITVSPDTKVLKAMQLMTDNRIRHIPVINDKGMIGMVSIGDVVRAVVSEHREELNRLNAYIQGGY

SEQ ID NO: 14057 - protein, 205 aa, Fraxinus spp
MQGGIQAIFSHGNVLKNAVLKHVRLVTPAMQPLMFIRHETVSAAHIEEHGFESTKIADILKAKGKNADGSWLWCTTDDTVYDAVKSMTQHNVGALVVVKPGEQKSIAGIITERDYLRKIIVQGRSSKSTKVGDIMTEENKLITVTPETKVLRAMQLMTDNRIRHIPVINDSGMIGMVSIGDVVRAVVSEHRDELNRLNAYIQGGY

SEQ ID NO: 14058 - protein, 205 aa, Mimulus guttatus
MQGGVQAIFSHGNVFKNAVLRHIRVGPTAVGSLMFARRESTSAARIEEHGFESTTISDVLTAKGKKQDGSWLWCTTDDSVYDAVKSMTQHNVGALVVVKPGEHKSVAGIITERDYLRKIIVQGRSSKSTKVGDIMTEENKLITVTPETKVLKAMQLMTDNRIRHIPVINDSGMIGMVSIGDVVRAVVSEHREELNRLNAFIQGGY

SEQ ID NO: 14059 - protein, 205 aa, Elaeis guineensis
MQGALQAIRAQGNVLKCAVLRHVRIMNPAMLPTAISRFESTSPAQLEEHGFESTTISDVLKAKGKGADGSWLWCTTDDTVYDAVKSMTQHNVGALVVVKPGADKAIAGIITERDYLRKIIVQGRSSKSTKVGDIMTEENKLITVTPDTKVLQAMQLMTDNRIRHIPVIDAKGMMGMVSIGDVVRAVVTEHREELDRLNAYIQGGY

SEQ ID NO: 14060 - protein, 205 aa, Petunia hybrida
MQGGFKQIISHGSVLKSAVLRHVRLVNPVTRPLMFARHETTSAARIEEHGFESTTISDILKGKGKGADGSWLWCTTDDSVYEAVKSMTQHNVGALVVVKPGENKAIAGIITERDYLRKIIVQGRSSKSTKVGDIMTEENKLITVTPETKVLKAMQLMTDNRIRHIPVIDQNGMIGMVSIGDVVRAVVSEHREELNRLNAFIQGGY

SEQ ID NO: 14061 - protein, 205 aa, Scabiosa columbaria
MQGGIRNILSHGSVFKNAVLQRVRLVNPVMRPLVFTRNESVSAARIEEHGFESTTISDILKGKGKSADGSWLWCTTDDTVYDAVKSMTQHNVGALVVVKPGEQKSIAGIITERDYLRKIIVQGRSSKSTKVGDIMTEENKLITVNPNTKVLKAMQLMTENRIRHIPVIDDKGMMGMVSIGDVVRAVVSEHREELNRLNAFIQGGY

SEQ ID NO: 14062 - protein, 205 aa, Juglans hindsii x Juglans regia
MQGALHSFLSRGSIIKNAVIQHFRLANPLIQPVIFSRSHSVTSARIEEHGFESTTIADVLKVKGKSADGSWLWCTMDDTVYDAVQSMTQHNVGALVVVKPGEQKSIAGIITERDYLRKIIVQGRSSKSTKVGDIMTEENKLITVTPDTKVLRAMQLMTDNRIRHIPVIEGNGMVGMVSIGDVVRAVVSEHREELNRLNAFIQGGY

SEQ ID NO: 14063 - protein, 176 aa, Gossypium raimondii
MAPRSKPSPISPNPDPNSKEIRYRGVRKRPWGRYAAEIRDPRKKTRVWLGTFDTAEEAARAYDAKAREFRGAKAKTNFADNNANDFTRSPSQSSTVESSSPPPLDLTLASACSSLPVTAQRPVYFFDAFATGGSGCPASGFAQSDSDSSSSVVDFEGGVRRRVFDLDLNQLPAEMD

SEQ ID NO: 14064 - protein, 176 aa, Gossypium hirsutum
MAPRSKPSPISPNPDPSSKEIRYRGVRKRPWGRYAAEIRDPRKKTRVWLGTFDTAEEAARAYDAKAREFRGAKAKTNFADNNANDFTRSPSQSSTVESSSPPPLDLTLASACSSLPVTAQRPVYFFDAFATGGSGCPASGFAQSDSDSSSSVVDFEGGVRRRVFDLDLNQLPAEMD

SEQ ID NO: 14065 - protein, 176 aa, Unknown
  Sequence found in Organisms: Theobroma cacao, Pteridium aquilinum
MAPRSKASPVNPISDPTSREIRYRGVRKRPWGRYAAEIRDPRKKTRVWLGTFDTAEEAARAYDAAAREFRGAKAKTNFTDNNNNDFTRSPSQSSTVESSSPPPLDLTLANASFSLPVTTHRPVFFFDAFASTGAGCPDTCGAHSDSDSSSSVVDFEGGVQRRVFDLDLNQLPAEMD

SEQ ID NO: 14066 - protein, 344 aa, Gossypium raimondii
MHPSKPLNLFFILTVMIRLCFADLPSFREAPAFRNGRECPQTTWSSLDKEIHNPSIIHIAMTLDTAYLRGSVAGVFSVLHHATCPENIVFHFVTTHRHGAKLTRAITSTFPYLNFHLYYFNTNLVKGKISSSIRRALDQPLNYARMYLADLLPAGVRRIIYFDSDLIVVDDVINLWSINLRSHVLGAPEYCHANFTNYFTSKFWSNPAFSASFKGRPRNPCYFNTGVMVIDLWKWREGKYTEKLENWMRIQKRYRIYELGSLPPFLLVFAGDVEGMEHRWNQHGLGGDNLEGLCRALHPGPVSLLHWSGKGKPWLRIDSKRPCPLDSLWAPYDLFRHPCLFSNS

SEQ ID NO: 14067 - protein, 344 aa, Theobroma cacao
MPSSKPLNIFLLLTVTINLCFAELPSFREAPAFRNGGECPKTTWSSLDKKVHNPSLIHIAMTLDTAYLRGSIAGVFSVLHHATCPENIVFHFITTHRRGAELTRAITSTFPYLNFHLYHFDSNLVKGKISSSIRRALDQPLNYARMYLADLLPAGVRRIIYFDSDLIVVDDVNKLWSINLGSHVLGAPEYCHANFTNYFTSKFWSNPVFTASFKGRSRNPCYFNTGVMVIDLWKWREGKYTEKLENWMRIQKRYRIYELGSLPPFLLVFAGNVEGMEHRWNQHGLGGDNLEGLCRALHPGPVSLLHWSGKGKPWLRIDSKKPCPLDSLWAPYDLFRHPSLFSDS

SEQ ID NO: 14068 - protein, 192 aa, Unknown
  Sequence found in Organisms: Gossypium hirsutum, Gossypium raimondii
MGTEVLRPQDCLIERIRLPPTACPRRRYGNGSFNPSYYHNYNNNNGNGRSNRKPVQRKRIGSEQGISKKYSSADDLKTVRNNVMVEKVTIMRRGESLDSKIKIDNGGGGREGGLVVMGTDRLGPDPEMVPKQIKIVDAKSSVTVKSDVYAGSAFSVSPAPSSLPLPTFSKKKQVPVDDSATRDLRRLLRLDL

SEQ ID NO: 14069 - protein, 191 aa, Unknown
  Sequence found in Organisms: Theobroma cacao, Pteridium aquilinum
MGTEVLRPQDCLIERIRFAPTACSRRRYGNGSFNPSYYYNNNNNNSGNGRFNRKPAHRKRTGSEQAISKRSSSADDLKTVRNNVTMEKVTLLRRGESLDSKIKSSSGGREGGLVVTGTDRLGPAPEMVPKQIKIVDIRSAVTAKSDVYAGSAFAVSPAPSSLPLPSFSKKKQVSIDDSATRDLRRLLRLDL

SEQ ID NO: 14070 - protein, 329 aa, Gossypium raimondii
MAEAEVGSGEGKPQEMSLKDKGNEFFKAGNYLKAAALYTQAIKQDPSNPTLYSNRAAAFLHLVKLNKALADAETTITLKPQWEKGYFRKGCILEAMERYDDALAAFQIALQYNPQSAEVSRKIKRLSQLAKDKKRAQEVQNLRSNVDIAKCLETLKSEMSEKYKSEDSWKEMFSFLVETMETAVKSWHETSKVDPRVYFLLDKEKSQADKYAPVVNIDKAFESPHTHSSCFSFLRQYAEDSFSRAACLVAPKSIIAYPQVWKGQGSRKWKHGQHDGFFVQFESPLLRKLWFISSSNEMGKTLCRDPEVLDIGAHEVFPRLFKEKLSSSS

SEQ ID NO: 14071 - protein, 329 aa, Gossypium raimondii
MAEAEVGSGEGKPQEMSLKDKGNEFFKAGNYLKAAALYTQAIKQDPSNPTLYSNRAAAFLNLVKLNKALADAETTITLKPQWEKGYFRKGCILEAMERYDDALAAFQIALQYNPQSAEVSRKIKRLSQLAKDKKRAQEVQNLRSNVDIAKCLETLKSEMSEKYKSEDSWKEMFSFLVETMETAVKSWHETSKVDPRVYFLLDKEKSQADKYAPVVNIDKAFESPHTHSSCFSFLRQYAEDSFSRAACLVAPKSIIAYPQVWKGQGSRKWKHGQHDGFFVQFESPLLRKLWFISSSNEMGKTLCRDPEVLDIGAHEVFPRLFKEKLSSSS

SEQ ID NO: 14072 - protein, 329 aa, Gossypium hirsutum
MAEAEVGSGEGKPQEMSLKDKGNEFFKAGNYLKAAALYTQAIKQDPSNPTLYSNRAAAFLNLVKLNKALADAETTITLKPQWEKGYFRKGCILEAMERYDDALAAFQIALQYNPQSAEVSRKIKRLSQLAKDKKRAQEVQNLRSNVDIAKCLETLKTEMSEKYKSEDSWKEMFSFLVETMETAVKSWHETSKVDPRVYFLLDKEKSQADKYAPVVNIDKAFESPHTHSSCFSFLRQYAEDSFSRAACLVAPKSIIAYPQVWKGQGSRKWKHGQHDGFFVQFESPLLRKLWFISSSNEMGKTLCRDPEVLDIGAHEVFPRLFKEKLSSSS

SEQ ID NO: 14073 - protein, 336 aa, Theobroma cacao
MAEAEVGSGKGGPAGGNGGEEEISLKDKGNEFFKAGNYLKAAALYTQAIKQDPSNPTLYSNRAAAFLNLVKLNKALTDAETTITLNPQWEKGYFRKGCILEAMERYDDALAAFQIALQYNPQSAEVSRKIKRLSQLAKDKKRAQEVQNLRSNVDMAKSLETLKSEMSEKYGAENCWKDMFLFLVETMEAAVKSWHETSKVDPRVYFLLDKEKTQTDKYAPVVNIDKAFESPHTHSSCFSFLRQYAEDSFSGAACLVAPKSIIAYPQVWKGQGSRKWRHGQHDGFFVQFESPLLRKLWFISSANEMGQTLCRAPDVLDIGAHELLPRLFKEKLSNSS

SEQ ID NO: 14074 - protein, 342 aa, Theobroma cacao
MAEAEVGSGKGGPAGGNGGEEEISLKDKGNEFFKAGNYLKAAALYTQAIKQDPSNPTLYSNRAAAFLNLVKLNKALTDAETTITLNPQWEKGYFRKGCILEAMERYDDALAAFQIALQYNPQSAEVSRKIKRLSQLAKDKKRAQEVQNLRSNVDMAKSLETLKSEMVLFSLPSEKYGAENCWKDMFLFLVETMEAAVKSWHETSKVDPRVYFLLDKEKTQTDKYAPVVNIDKAFESPHTHSSCFSFLRQYAEDSFSGAACLVAPKSIIAYPQVWKGQGSRKWRHGQHDGFFVQFESPLLRKLWFISSANEMGQTLCRAPDVLDIGAHELLPRLFKEKLSNSS

SEQ ID NO: 14075 - protein, 231 aa, Fagus grandifolia
MTMPWLPFKQLCNTIHKVLKYTKKIKRISQLARDKKRAQEVENKKSNIDMAKHLEKLKSEMSEKCGSEESWKEIFSFLVETMETAVKSWHKTSKVDPRVYFLLDNEKTQTDKYAPVVNIDKAFESPHTHSSCFPFLRQYAEDSFSRAACVVAPKSIISYPQVWKGQGSRKWKHGQHDGFFVQFESPSLRKLWFIPSSNEMGQTLCRDPEVLDISSHELLPRVFRENLPKSS

SEQ ID NO: 14076 - protein, 330 aa, Ricinus communis
MAGSATAASTDGNGGEEVSLKDKGNEFFKAGNYLKAAALYTQAIKLDPSNPTLYSNRAAAFLQLVKLNKALADAEMTITLNPQWEKGYFRKGCVLEAMERYDDASAAFQTALKYNPQSSEVSRKIKRISQLAKEKKRAQEVESMRSNVDLAKHFDKLKSEMSEKIGSEECLKEIFSFLVETMEMAVKSWHETSKVDPRVYFLLDKEKTQSDKYAPAVNIDKAFESPHTHSSCFTFLRQYAEESFSKAACLVAPKSIISYPQVWKGQGSRKWKHGQHDGFFVQFESPCLRKLWFISSTNEKGQTLCRDPEMLDISAHEVFPRLFKEKLPNS

SEQ ID NO: 14077 - protein, 329 aa, Manihot esculenta
MAGSAAASMEGNGGEEVSLKDKGNEFFKAGNYLKAAALYTQAIKLDPSNPTLYSNRAAAFLQLVKLNKALADAETTITLNPQWEKGYFRKGCVLEAMEQYDDALAAFQTSLQYNPQSTEVSRKIKRISQLAKEKKRAQEMESKRSNVDMAKHLDTLKSEMSEKIASEECWKEMFSFLVETMETAVKSWHETSKVDPRVYFLLDKEKTQTDKYAPVVNIDKAFESPHTHSSCVTFLRQYAEESFSKEACLVVPKSIISYPQVWKGQGSRKWKHGQHDGFFVQLESPFLRKLWFIPSTSEKGQTLCRDPEPLDISSHEVLPRVFKEKLPNS

SEQ ID NO: 14078 - protein, 330 aa, Manihot esculenta
MAGSASSASAEGNGGDEVSLKEKGNEFFKAGNYLKAAALYTQAIKLDPSNPALYSNRAAAFLQLVKLNKALADAETTITLNPQWEKGYFRKGCVLEAMERYDDALAAFQTSLQYNPQSTEVSRKIRRISQLAKDKKRAQEVDSIRSNVDLAKHLGTLKSEMSEKIGSEECLKEIFSFLIETMETAVKSWHETSKVDPRVYFLLHKEKTETDEYAPVVNIDKAFESPHTHSDCFTFLRQYAEKSFSKAACLVVPKSIISYPQVWKGQGSRKWKYGQHDGFFVQLESPFLRKLWFIPSTSEKGQTLCRDPEPLDISAHEVLPRLFKEKLPNS

SEQ ID NO: 14079 - protein, 334 aa, Populus trichocarpa
MAEAEKGSATTGSKESNVKEEISLKDKGNEFFKAGNYLKAAALYTQAIKLDPSNPTLYSNRAAAFLQLVKLNKALADAETTIKLNPQWEKGYFRKGCVLEGMERYDDALATFQIALQHNPQSTEVSRKIKRISQLARDKKRAQEVQSMRSNVDMAKHLETLKSEMFEKLGSEECFKDMFSFLVETMETAVKSWHEASKVDPRVYFLLDKEKTQTDKYAPVVNIDKAFESPHSHSNCFSFLRQYADDSFSKAACLVVPKNIISYPQVWKGQGSRKWKYGQHDGFFVQYESHLMRKIWFIASTNEKGQTLCRDPEVLDIGAHEVLPRLFKEKLTNP

SEQ ID NO: 14080 - protein, 148 aa, Tripterygium wilfordii
MAEAVARSSAATGGGEEVSLKEKGNEFFKAGNYLKAAALYTQAIKLDPSNPSLYSNRAAAFLQLVKLNKALADSETTIALNPQWEKGYFRKGCILEAMERYDDALAAFQTALQYNSQSAEVSRKIKRISQLAKDKKTSPGSGKHEVKC

SEQ ID NO: 14081 - protein, 334 aa, Populus trichocarpa
MAEAEKGSATTGSNEGNGKEEISLKDKGNEFFKAGNYLKAAALYTQAIKLDPSNPTLYSNRAAAFLQLVKLNKALADAETTITLNPQWEKGYFRKGCVLEAMEQYDNALATFQIALQYNPRSTEVSRKIKRISQLAKDKKRAQEVESMRSNVNMEKHLETLKSEMSEMLGSEECFKEMFSFLVETMETAVKSWHEASKVDPRVYFLLDKEKTLTDKYAPVVNIDKAFESPHTHGNCFSFLRQYAEDSFSKAACVVVPKNIISYPQVWKGQGSRKWRHGQHDGIFVQYESPLMRKIWFIASSNEKGQTLCRDPEILDISAHEVLPRLFKEKMPNP

SEQ ID NO: 14082 - protein, 320 aa, Unknown
  Sequence found in Organisms: Citrus clementina, Citrus sinensis
MAAEAEEMSLKDKGNEFFKAGNYLKAAALYTQAIKQDPSNPTLFSNRAAAFLHLVKLNKALADAETTISLNPQWEKGYFRKGCILEAMEQYDDALSAFQTALQYNPQSAEVSRKIKRVSQLAKDKKRAQEVENIRSNVDMVQHLDEFKSEMSEKYGAEECWKHVFSFVVETMETAVKSWHETSKVDAKVYFLLDKEKTDTEKYAPIVNVDKAFESPHTHGSCFQFLRQYADDSFSSAACLVAPKSIISYPQVWRGQGLRKWRHSQQDGFFVQFESPLLRKLWFIPSSNEKGKTLCRDPEVLDISAHEVFPRLFKEKLSNS

SEQ ID NO: 14083 - protein, 324 aa, Cajanus cajan
MAETKEGSGPEMSLKDQGNEFFKSGKYLKAAALYTQAIKQDPSNPTLYSNRAAALLQLDKLNKALDDAEMTIKLKPQWEKGYFRKGSILEAMKRYDDALAAFQIALQYNPQSQEVSKKIKKINQLVRDSKRAQEVENMRSNVDMAKHLDTLKPEMSGKYGSEECWKDMFLFLVETMETSVKSWHETSSVDARVHFLLDMEKTQTDKYAPVVNIDKAFESPHTHSNCISFLRQYAEESFSKAACLVTPKSIIAYPQVWKGQGSRKWKHAQSDGFFVQFESPSLRKLWFIPSSNEKGQTLCRDPEVLDIGAHEVLPRLFKENMPRS

SEQ ID NO: 14084 - protein, 335 aa, Quercus alba
MSEATAEPKSGAVSSSGGGGGGGEMSLKDKGNEFFKAGNYLKALYTQAIKLDPSNPTLYSNRAAAFLQLVKLNKALADAETTITLKPQWEKGYFRKGCILEAMEQYDDALAAFQTALQYNPQSSEVSKKIKRISQLSRDKKRAQEVENKRSNIDMAKHLEKLKSEMSEKWGPEESWKEIFSFLVETMETAVKSWHETSKVDPKVYFLLDNEKTQTDKYAPVVNIDKAFESPHTHSSCFSFLRQYADDSFSRAACVVAPKSIISYPQVWKGQGSRKWKHGQHDGFFVQFESPSLRQLWFIPSSSEMGQTVCRDPEVLDISVHEVLPRVFRETLPKS

SEQ ID NO: 14085 - protein, 330 aa, Euonymus alatus
MAEAEARSTAAAGGGEEVSLKDKGNEFFKAGNYLKAAALYTQAIKLDPSNPSLYSNRAAAFLQLAKLNKALADSETTIALNPQWEKGYFRKGCILEAMERYDDALAAFQTALQYSTQSAEVSRKIKRISQLAKDKNEAQEVENLRSNVDMAKHLDTLRSELSEKLGSEDSFKEMFSFIVETMEMAVKSWHENAKVDPRVYFLLDKEKTQIDKYAPAVNIDKAFESPHTHGSCFSFLRQYAEESFSKAACLVTPKSIISYPQVWKGQGPRKWRHGQHDGFFVQFESPFLRKIWFIPSLHEKGQTLCRDPDALDISAHEVIPRIFKEHSMGA

SEQ ID NO: 14086 - protein, 324 aa, Cicer arietinum
MAETKEGSNTEMSLKDQGNEFFKSGKYLKAAALYTQAIKKDPSNPTLYSNRAAALLQLDKLNKALDDAEMTIKLKPQWEKGHFRKGCILEAMKRYDDALASFQIASQYNPQSQEVSKKIKKINQLVKDSKRAQEVENLRSNIDMAKHLDTFKSEMSEKYGSEESWKDIFSFLVETMETAVKSWHGTSSVDARVYFLPDKEKTQTDKYPPIVNIDKAFESPQTHSSCFSFLRQYAEESFSKAACLVAAKNIIAYPQVWKGQGSRKWKHAQNDGFFVQFESPSLRKLWFISSSNEKGQTLCREPEVLDIGAHEVVPRLFKEKTSRA

SEQ ID NO: 14087 - protein, 606 aa, Gossypium raimondii
MNKNWKFVRLRQEFQVGVLLLLLCQSLACWSLNEEGFALLRLRERVVNDPFGALWAWKEEDGEINHCSWFGVECCDGKVIALNLKDLCLEGTLAPELGTLIHIKSIILRNNSFTGTIPEGISKLKELEVLDLGYNNFNESLPSGLSSDLSLTIQNSDRSEGAVLRKLLQETANTSAKSPKAPTHPASSELSTNSTYLRDAPVPRPPPSPVPQPPSAPASKPSGNDTVPNTSAPSPSGSNPSISDSKSSHEAAILVGSIGGGTFLLILIIIAYLLKTYKVSTVKPWATGLSGQLQKAFVTGVPKLKRSELEAACEDFSNVIGSTMIGTVYKGTLSNGVEIAVVSVPVESTKDWSKNLETQFRKKIDTLSKVNHKNFVNLLGYCEEDNPFTRMLVFEYAPNGTLFEHLHIKESEHLDWAMRLRIIMGMAYCLEHMHQLNPPVPHNNLSSSAVSLTEDYAAKISDSCFWNELTASDREADGINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSTEAS

SEQ ID NO: 14088 - protein, 606 aa, Gossypium raimondii
MNKNWKFVRLRQEFQVGVLLLLLCQSLACWSLNEEGFALLRLRERVVNDPFGALWAWKEEDGEINHCSWFGVECCDGKVIALNLKDLCLEGTLAPELGTLIHIKSIILRNNSFTGTIPEGISKLKELEVLDLGYNNFNESLPSGLSSDLSLTIQNSDRSEGAVLRKLLQETANTSAKSPKAPTHPASSELSTNSTYLRDAPVPRPPPSPVPRPPSAPASKPSGNDTVPNTSAPSPSGSNPSISDSKSSHEAAILVGSIGGGTFLLILIIIAYLLKTYKVSTVKPWATGLSGQLQKAFVTGVPKLKRSELEAACEDFSNVIGSTMIGTVYKGTLSNGVEIAVVSVPVESTKDWSKNLETQFRKKIDTLSKVNHKNFVNLLGYCEEDNPFTRMLVFEYAPNGTLFEHLHIKESEHLDWAMRLRIIMGMAYCLEHMHQLNPPVPHNNLSSSAVSLTEDYAAKISDSCFWNELTASDREADGINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSTEAS

SEQ ID NO: 14089 - protein, 606 aa, Gossypium hirsutum
MNKNWKFVRLRQEFQVGVLLLLLCQSLACWSLNEEGFALLRLRERVVNDPFGALWAWKEEDGEINHCSWFGVECCDGKVIALNLKDLCLEGTLAPELGTLIHIKSIILRNNSFTGTIPEGISKLKELEVLDLGYNNFNESLPSGLSSDLSLTIQNSDRSEGAVLRKLLQETENTSAKSPKAPTHPASSELSTNSTYLRDAPVPRPLPTPVPRPPSAPASKPSGNDTVPNTSAPSPSGSNPSISDSKSSHEAAILVGSIGGGTFLLILIIIAYLLKTYKVSTVKPWATGLSGQLQKAFVTGVPKLKRSELEAACEDFSNVIGSTMIGTVYKGTLSNGVEIAVVSVPVESTKDWSKNLETQFRKKIDTLSKVNHKNFVNLLGYCEEDNPFTRMLVFEYAPNGTLFEHLHIKESEHLDWAMRLRIIMGMAYCLEHMHQLNPPVPHNNLSSSAVSLTEDYAAKISDSCFWNELTASDREADGINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSTEAS

SEQ ID NO: 14090 - protein, 243 aa, Unknown
  Sequence found in Organisms: Gossypium hirsutum, Gossypium raimondii
MRQQYVFTTLTLLILFSLSCSTTLAQAPALAPAPSGPTNVTKILEKAGQFTLFIRLLKSTQVANQLLGQLNNSNNGMTVFAPTDNAFSSLKSGTLNSLTDEQKVELVQFHIVPTYLTSSQFQTISNPLRTQAGDSGDGKFPLNITTSGNSVNITTGLTNTSVSGTIYTDGQLAVYQIDQVLQPLQIFAPRPPAPAPAPAKSKNKKATTVADSPDVTPADNSKAATLQNVGLFGVAALVIALSL

SEQ ID NO: 14091 - protein, 85 aa, Gossypium raimondii
QPRQFLEKAGQFTLFIRLLKSTQVANQLLGQLNNSNNGMTVFAPTDNAFSSLKSGTLNSLTDDKSAAGAIPHRPNIPHLVSVPNH

SEQ ID NO: 14092 - protein, 247 aa, Theobroma cacao
MMKQHLFILSFLLLSFLRCPQTLAQAPALAPALAPAPPGPTNVTKILEKAGQFTLFIRLLKATAVANQLLGQLNNTNNGMTIFAPTDNAFSSLKSGTLNSLSDEQKVELVQFHIIPTYLSSTQFQTISNPLRTQAGDSADGKFPLNVTTSGNSVNITTGLTNTSVSGTIYTDGQLAVYQVDKVLQPLQIFDPRPPAPAPAPAKSKKKAAVADSPDDTPADNSKAVSTLTMQNVVFWGVSAIVLALSL

SEQ ID NO: 14093 - protein, 246 aa, Unknown
  Sequence found in Organisms: Theobroma cacao, Pteridium aquilinum
MKQHLFILSFLLLSFLRCPQTLAQAPALAPALAPAPPGPTNVTKILEKAGQFTLFIRLLKATAVANQLLGQLNNTNNGMTIFAPTDNAFSSLKSGTLNSLSDEQKVELVQFHIIPTYLSSTQFQTISNPLRTQAGDSADGKFPLNVTTSGNSVNITTGLTNTSVSGTIYTDGQLAVYQVDKVLQPLQIFDPRPPAPAPAPAKSKKKAAVADSPDDTPADNSKAVSTLTMQNVVFWGVSAIVLALSL

SEQ ID NO: 14094 - protein, 255 aa, Gossypium hirsutum
MLGIFKKELMNPPKELHSPASLTSSNKPKLPNQIINHFLSSNPNNAFSMGFGSSACFAYAPSENRFPNHQRLFCGVDEIYCIFLGDLNNLSSLLKQYGLSKGTNEAMFIIEAYRTLRDRGPYPADQVLKDLEGSYGFVVYDSKAGSVFAALGADERVKLYWGVAADGSVVVSDNLKLIKESCAKSFAPFPPGCMFHSEQGLTSFEHPRSKMKAMPRIDSEGVMCGANFMADAQSRTSRMPRVGSEANWALRGSKA

SEQ ID NO: 14095 - protein, 255 aa, Gossypium raimondii
MLGIFKKELMNPPKELHSPASLTSSNKPKLPNQIINHFLSSNPNNAFSMGFGSSACFAYAPTENRFPSHQRLFCGVDEIYCIFLGDLNNLSSLLKQYGLSKGTNEAMFIIEAYRTLRDRGPYPADQVLKDLEGSYGFVVYDSKAGSVFAALGADERVKLYWGVAADGSVVVSDNLKLIKESCAKSFAPFPPGCMFHSEQGLTSFEHPRSKMKAMPRIDSEGVMCGANFMADAQSRTSRMPRVGSEANWALRGSKA

SEQ ID NO: 14096 - protein, 255 aa, Gossypium hirsutum
MLGIFKKELMNPPKELHSPASLTSSNKPKLPNQIINHFLSSNPNNAFSMGFGSSACFAYAPTENRFPSHQRLFCGVDEIYCIFLGDLNNLSSLLKQYGLSKGTNEAMFIIEAYRTLRDRGPYPADQVLKDLEGSYGFVVYDSKAGSVFAALGADERVNLYWGVAADGSVVVSDNLKLIKESCAKSFAPFPPGCMFHSEQGLMSFEHPRSKMKAMPRIDSEGVMCGANFMADAQSRTSRMPRVGSEANWALRGSKA

SEQ ID NO: 14097 - protein, 255 aa, Gossypium raimondii
MLGIFKKELMNPPKELHSPASLTSSNKPKLPNQIINHFLSSNPNNAVSMGFGSSACFAYAPTENRFPSHQRLFCGVDEIYCIFLGDLNNLSSLLKQYGLSKGTNEAMFIIEAYRTLRDRGPYPADQVLKDLEGSYGFVVYDSKAGSVFAALGADERVNLYWGVAADGSVVVSDNLKLIKESCAKSFAPFPPGCMFHSEQGLMSFEHPRSKMKAMPRIDSEGVMCGANFMADAQSRTSRMPRVGSEANWALRGSKA

SEQ ID NO: 14098 - protein, 255 aa, Unknown
  Sequence found in Organisms: Theobroma cacao, Pteridium aquilinum
MLAIFNKGLVNPPKELHSPASVSSSRKPKLPVEILEDFLSANPNNAFSIGFGAAASLAYVPQQNSCTTYQRLFCGVDEIYCIFLGSLNNLCSLLRQYGLSKGTNEAMFIIEAYRTLRDRGPYPAHQVLKDLEGSYGFVVYDGKAGSVFAALGADEAVNLFWGIAADGSVVVSDNLKVIKESCAKSFAPFPAGCMFHSEQGLMSFEHPRSEMKAMPRIDSEGVMCGADFKADVQSRISSMPRVGSEANWALRGSTA

SEQ ID NO: 14099 - protein, 443 aa, Gossypium hirsutum
MAAYRLLIFSLFLALVFTKIGADASTEPLLESDAADSSALKMELDQLKSKIRLLESNVEEKIRELKTKDEMIKQKDKIIEEKSDTMASLHSELSSLQKKGTPDAEERVGKAHAKALELQKQVDRLKTELEAKLKEKDYLESRATKAENKLNELNLQLENLQKINKEQENKLAKTERALNIAEEELVKAKFDATSKANELMEVHSAWLPPWLATQLIRGQAFIQTHWNQHGKPNMDMVIQKALEKKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQENLKKHELTRPLATKELEWFAASALLALPIIILFRIFSAIFCKKTKKRVRHTNATHHGRRKGKRGHTDK

SEQ ID NO: 14100 - protein, 443 aa, Gossypium raimondii
MAAYRLLIFSLFLALVFTKIGADASTEPLLESDAADSSALKMELDQLKSKIRLLESNVEEKIRELKTKDEMIKQKDKIIEEKSDTMASLHSELSSLQKKGTSDAEERVGKAHAKALELQKQVDRLKTELEAKLKEKDYLESRATKAENKLNELNLQLENLQKINKEQENKLAKTERALNIAEEELIKAKFDATSKANELMEVHSAWLPPWLATQLIRGQAFIQTHWNQHGKPNMDMVIQKALEKKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQENLKKHELTRPLATKELEWFAASALLALPIIILFRIFSAIFCKKTKKRVRHTNATHHGRRKGKRGHTDK

SEQ ID NO: 14101 - protein, 245 aa, Gossypium raimondii
MAASAGAMDGLAASALRSVLQRVHQTAERCGRESQRIRVVAVSKTKPVSVIRQVYDAGHRCFGENYVQEIVKKAPQLPDDIEWHFIGNLQSNKVKPLIAGVPNLAMVETVDDEKIANHLNRVVGSFERKPLKVLVQVNTSGEESKSGVEPSGCVELVKHVSLNCPNLQFCGLMTIGMPDYTSTPENFKTLANCRSEVCKALGIPEEQCELSMGMSSDFELAIEMGSTNVRVGSTIFGAREYPKKN

SEQ ID NO: 14102 - protein, 245 aa, Gossypium raimondii
MAASAGAMDGLAASALRSVLQRVHQTAERCGRESQRIHVVAVSKTKPVSVIRQVYDAGHRCFGENYVQEIVEKAPQLPDDIEWHFIGNLQSNKVKPLIAGVPNLAMVETVDDEKIANHLNHVVGSFERKPLKVLVQVNTSGEESKSGVEPSGCVELVKHVSLNCPNLQFCGLMTIGMPDYTSTPENFKTLANCRSEVCKALGIPEEQCELSMGMSSDFELAIEMGSTNVRVGSTIFGAREYPKKN

SEQ ID NO: 14103 - protein, 245 aa, Gossypium hirsutum
MAASAGAMDGLAASALRSVLQRVHQTAERCGRESQRIHVVAVSKTKPVSVIRQVYDAGHRCFGENYVQEIVEKAPQLPDDIEWHFIGNLQSNKVKPLIAGVPNLAMVETVDDEKIANHLNHVVGSFERKPLKVLVQVNTSGEESKSGVEPSGCVELVKHVSLNCPNLQFCGLMTIGMPDYTSTPENFKTLANCRSEVCKVLGIPEEQCELSMGMSSDFELAIEMGSTNVRVGSTIFGAREYPKKK

SEQ ID NO: 14104 - protein, 264 aa, Euphorbia esula
  misc_feature (5)..(5): Xaa can be any naturally occurring amino acid
MMNTXEEEANTTDNPTQQSEMAAASAAMDGVAASALRSVLQRVNQAAERAGRSSQQIRVVAVSKTKPVSVLRQVYDAGHRCFGENYVQELIEKAPQLPEDIEWHFIGNLQSNKVKPLLNGVPNLAMVETVDDEKIANHLDRAIGNLGRKPLKVLIQVNTSGEESKSGVEPSGCVELAKHVQSCANLEFSGLMTIGMLDYTSTPENFKTLANCRTEVCKALGIPEEQCELSMGMSGDFELAIEMGSTNVRVGSTIFGAREYPKKK

SEQ ID NO: 14105 - protein, 266 aa, Manihot esculenta
MNNLEDQAKIDNATAQQVAQSDMAAASAAMDGVAAAALRSVLQRVQQAAERAGRGSQHIRVVAVSKTKPVSVIRQVYDAGHRCFGENYVQEIVEKAPQLPEDIEWHFIGNLQSNKAKPLLAGVPNLAMVESVDDEKIANHLNRAVGNLGRKRLKVLIQVNTSGEESKSGVEPSACVELAKHVNQNCPNLEFCGLMTIGMLDYSSTPENFKTLTNCRSEVCKALGIPEEQCELSMGMSNDFEQAIEMGSTNVRIGSTIFGPREYQKK

SEQ ID NO: 14106 - protein, 259 aa, Euphorbia peplus
MNPLEEEANTTDNPTQQSEMAAASAAMDGVAASALRSVLQRVNQAAERAGRSSQQIRVVAVSKTKPVSVLRQVYDAGHRCFGENYVQELIEKAPQLPEDIEWHFIGNLQSNKVKPLLNGVPNLAMVETVDDEKIANHLDRAIGNLGRKPLKVLIQVNTSGEESKSGVEPSGCVELAKHVQSCANLEFSGLMTIGMLDYTSTPENFKTLANCRTEVCKALGIPEEQCELSMGMSGDFELAIEMGSTNVRVGSTIFGAREY

SEQ ID NO: 14107 - protein, 244 aa, Lippia dulcis
MTAASAAEGVAAAALRSVLQRVQQAAERSGRTSDRIRVVAVSKTKPVSLLRQVYDAGHRSFGENYVQEIVEKAPQLPDDIEWHFIGNLQSNKVKPLISGVPNLAMVETIDDGKIANHLNRAIGNAGRKPLKVMVQVNTSGEESKSGVEPSACVELAKHVSMNCPNLEFCGLMTIGMPDYTSTPENFKTLAKCRSEVCEALGIAEEQCELSMGMSGDFELAIEMGSTNIRIGSTIFGAREYPKKK

SEQ ID NO: 14108 - protein, 245 aa, Tropaeolum majus
MAASSAALDGVAAVALRSVLHRVHQVAEKAGRVPERIRVVAVSKTKPVSILRQVYDAGHRCFGENYVQEIVEKAPQLPDDIEWHFIGNLQSNKVKTLLAGVPNLAMVETVDDEKIANHLDRAVGNHGRQPLKVLVQVNTSGEESKNGVEPSGCVDLAKHVGLACPNLLFCGLMTIGMLDYTSTPENFKTLVNCRTEVCKALGIPEEQCELSMGMSGDFEQAIEMGSTNVRVGSTIFGAREYPKKK

SEQ ID NO: 14109 - protein, 244 aa, Ipomoea nil
MASSAAIDGVASTALRSVLQRVQQAGERCGRQSDRIRVVAVSKTKPASLIRQVYDSGHRCFGENYVQELVDKAPQLPEDIEWHFIGNLQSNKVKPLLTGVPNLAMVETVDDEKIANQLNRVVGNIGRKPLKVFVQVNTSGEETKSGVEPAACVDLVKHISSSCPNLEFSGLMTIGMPDYTSTPENFKTLANCRSEVCKALGIAEEQCELSMGMSGDFELAIEMGSTNVRVGSTIFGAREYPKKQ

SEQ ID NO: 14110 - protein, 244 aa, Citrus sinensis
MAASAATDGVAATALRSVIQRVHQAAERSSRPPDRIRIVAVSKTKPVSVIRQVYEAGHRCFGENYVQEIVEKAAQLPDDLEWHFIGNLQSNKVKPLLAGVPNLAMVESVDNEKIAGRLNRMVETMGRKPLKVLVQVNTSGEESKSGVEPSGCLELVKHVSQNCPNLEFCGLMTIGMPDYTSTPENFKTLAKCRSEVCKALGIPEEQCDLSMGMSGDFELAIEMGSTNVRIGSTIFGAREYPKKN

SEQ ID NO: 14111 - protein, 386 aa, Gossypium raimondii
MTTTKKNMLPPGLVNNLQEVLLSRKGGNSNTNNDEQQQKPDAVTDSTETSTSASDENDNSKPVVLVTNGEGIDSLGLVYLVQALVRSGLYNVHVCAPQSDKSVSSHSVTVRETITVTPAEIDGATAYEVSGTPVDCVSLALSGALFSWSKPLLVISGINRGSSCGHHMFYSGVVAGAREALVSGVPSLSISLNWKREESQESDFKDAVAVCLPLITAAIRDIEKGVFPKSCFLSIEIPTSPSANKGFKLTKQSMWRSAPNWLAVSANRHPSSAAHFMSNQQSLGLQLAQLSRDASAAGAARRISAQRQNVEVESVGAVKSDTNKVKKYFRLEFINKEQEEAEEDLDFKALDNGFVAVTPFSLCPQIEVDIQTAASDWISGALQVEQ

SEQ ID NO: 14112 - protein, 386 aa, Gossypium raimondii
MTTTKKNMLPPGLVNNLQEVLLSRKGGNSNTNNDEQQQKPDAITDSTETSTSASDENDNSKPVVLVTNGEGIDSLGLVYLVQALVRSGLYNVHVCAPQSDKSVSSHSVTVRETITVTPAEIDGATAYEVSGTPVDCVSLALSGALFSWSKPLLVISGINRGSSCGHHMFYSGVVAGAREALVSGVPSLSISLNWKREESQESDFKDAVAVCLPLITAAIRDIEKGVFPKSCFLSIEIPTSPSANKGFKLTKQSMWRSAPNWLAVSANRHPSSAAHFMSNQQSLGLQLAQLSRDASAAGAARRISAQRQNVEVESVGAVKSDTNKVKKYFRLEFINKEQEEAEEYLDFKALDNGFVAVTPFSLCPQIEVDIQTAASDWISSALQVEQ

SEQ ID NO: 14113 - protein, 386 aa, Gossypium hirsutum
MTTAKKNMLPPGLVNNLQEVLLSRKGGNSNTNNDEQQQKPDAITDSTETSTSASDENDNSKPVVLVTNGEGIDSLGLVYLVQALVRSGLYNVHVCAPQSDKSVSGHSVTVRETITVTPAEIDGATAYEVSGTPVDCVSLALSGALFSWSKPLLVISGINRGSSCGHHMFYSGVVAGAREALISGVPSLSISLNWKREESQESDFKDAVAVCLPLITAAIRDIEKGVFPKSCFLSIEIPTSPSANKGFKLTKQSMWRSAPNWLAVSANRHPSSAAHFMSNQQSLGLQLAQLSRDASAAGAARRISAQRQNVEVESVGAIKSDTNKVKKYFRLEFINKEQEEAEEYLDFKALDNGFVAVTPFSLCPQIEVDIQTAASDWISSALQVEQ

SEQ ID NO: 14114 - protein, 388 aa, Theobroma cacao
MTTTSVKKNMLPPGLVNNLQEVLLSRKGGNNNNEQQKDDSAADSTEPSTSTCNEDTADSNDSSKPVVLLTNGEGIDSLGLVYLVQALVRLGLYNVHVCAPQSDKSVSGHSVTLRETIAVTPAEIDGATAYEVSGTTVDCVSLALSGALFSWSKPLLVISGINRGSSCGHHMFYSGVVAGAREALICGVPSLSISLNWKREESQESDFKDAVAVCLPLINAAIRDIEKGVFPKSCFLSIEIPTSPSANKGFKLTKQSFWRSAPSWQAVSANRHPSAAHFMSNQQSLGIQLAQLSRDASAAGAARRLTTQRKNVEIESVGAAKSDTKKVKKYFRLEFVDREQEDTDEDLDFRALDNGFVAVTPLSLSPQIESDIQTAASDWISSALHGEQ

SEQ ID NO: 14115 - protein, 548 aa, Unknown
  Sequence found in Organisms: Gossypium hirsutum, Gossypium raimondii
MQTSQKHQTRVNIHRLYHQPVKDVDQFCLPHIQILENNACSDIGSQGPSVSYQAYNDQIFTLESSTAAASIVAYDSPSAISVSSSRSPFSPQGSQSWMSDPHHSPDNTHGSPFSGSSVVDDSNGLKHKLRELEVSLLGPESDIIDSCNCCFTSGAHQAASMAGLNHEQLVDMIPRLDLKEVLIACGQALYDNDKSRVAGLMHVLEKMVSVSGEPLQRLGAYVLEGLRARLESSGSNIYKALKCQEPTSSELMSYMHILFRICPYWKFAYTSANAVIKEVMEYEQRIHIIDFQIAQGTQWMYLIAALSKRPGGPPFIRVTGIDDSQSNHARGGGLSIVGQKLSEFAKSYKVPFEFHDTSVSTSEIQVQNLNIRPGEALAVNFPYVLHHMPDESVTISNHRDRLLRLVKSLSPKVVTLVEQESNTNTSPFFSRYIETLNYYTAMFESIDVACPRDDKQRISAEQHCVARDIVNMIACEGQERVERHELLGKWRSRFMMAGFSPYPLSSLVTSAVRDMLKEYNNNYRVVEREGSLYLGWINRAMATSSAWR

SEQ ID NO: 14116 - protein, 548 aa, Theobroma cacao
MQTSQKHQTSACIRRLYHQPVQEMEALCLPHIQILDNNVCSDVGSQGTSVSFQTYKDQFFTLESSTATAGFVVYDSPSAVSISSSRSPFSPQGSQSYLSDPHHSPDNTYGSPFSGSSVVDDGNEWKHKLRELEISLLGPESDVIDSCNCCFSSGAHQAASMASFNCNQLVEMIPRLDLKQVLVACGQALHEGDMPTVAGLMHVLEKMVSVSGEPIQRLGAYVLEGLRARLESSGSSIYKALKCKEPTSSELMSYMHILFKVCPFWKFAYTSANVVIREVMEYEPKIHIIDFQIAQGTQWMFLIAALAKRPGGPPAIRITGIDDSQSNHARGGGLNIVGQRLSEFAKTYNVPFEFHDAAMSGCEVQLEHLKVQPGEALAVNFPYVLHHMPDESVSTWNHRDRLLRLVKSLLPKIVTLVEQESNTNTSPFFSRYLETLDYYTAMFESIDVACSRDDKQRINAEQHCVARDIVNMIACEGPERVERHELFGKWRSRFTMAGFSPYPLSSSVTMAVRDVLKDYNNNYRLEEREGALYLGWINRAMATSSAWR

SEQ ID NO: 14117 - protein, 136 aa, Unknown
  Sequence found in Organisms: Gossypium hirsutum, Gossypium raimondii
MAAEEGKTADAQFFHLLSNLLHQVEALTNQEEVELRSKIEALGLEVTKVPSKSTHSLDELEIARELDKLSAKLDGVDEMISSAMAADPQVRSLLSGTADVWMPVITANADERRNLAASISTDNPLGNNEDDNKPDN

SEQ ID NO: 14118 - protein, 425 aa, Cicer arietinum
MEMERIVEFSRTYMDRPPRKRARLGWDIVEVPKAQVGLFCAQEVENISSYAPSEHISSSLFKGVARNGSPPWRDDDKDGHYMFELGDNLTSRYKIHGKMGEGTFGQVLECWDRERKEMVAIKVVRAIKKYREAAMIEIEMLQQLGKHDKGGNRCVQIRNWFDYRNHICIVFEKLGPSLYDFLRKNNYRSFPIDLVREIGRQLLECIAFMHDLHMIHTDLKPENILLVSSEYLKIPDYKSSSRLPCSFFKRVPKSSAIKVIDFGSTTYERENQNYIVSTRHYRAPEVILGLGWSYPCDIWSVGCILVELCTGEALFQTHENLEHLAMMERVLGPLPQQMLKKVDRHAEKYVRRGRLDWPEGATSRESIKAVMKLPRLQNLIMQHVDHSAGDLIHLLQGLLRYDPFERLTARDALRHSFFMRDHLRR

SEQ ID NO: 14119 - protein, 425 aa, Glycine max
MEMERIVEFPHTYMDRPPRKRARLGWDIAEAPKAQVGLFCGQEVENISSYAPSEHPPSSLFKGVARNGSPPWRDDDKDGHYMFELGDNLTSRYKIHSKMGEGTFGQVLECWDRERKEMVAIKIVRGIKKYREAAMIEIEVLQQLGKHDKGSNRCVQIRNWFDYRNHICIVFEKLGPSLYDFLRKNSYRSFPIDLVREIGWQLLECVAFMHDLRMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGAISRESIKAVMKLPRLQNLIMQHVDHSAGDLIHLLQGLLRYDPFERLTARDALRHSFFMRDHLRR

SEQ ID NO: 14120 - protein, 425 aa, Cajanus cajan
MEMERIVEFPHTYMDRPPRKRARLGWDIAEAPKAQVGLFCGQEVENISSFAPSEHPTSSLFKGVARNGSPPWRDDDKDGHYMFELGDNLTSRYKIHSKMGEGTFGQVLECWDRERKEMVAIKIVRGIKKYREAAMIEIEVLQQLGKHDKGSNRCVQIRNWFDYRNHICIVFEKLGPSLYDFLRKNSYRSFPIDLVREIGWQLLECVAFMHDLRMIHTDLKPENILLVSPEYLKIPDYKSTSKSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGATSRESIKAVMKLPRLQNLIMQHVDHSAGDLIHLLQGLLRYDPFERLTARDALRHSFFTRDHLRR

SEQ ID NO: 14121 - protein, 425 aa, Glycine max
MEMERIVEFPHTYMDRPPRKRARLGWDIAEVPKAQVGLFCGQEVENISSFAPSEHPPSSLFKGVARNGSPPWRDDDKDGHYMFELGDNLTSRYKIHGKMGEGTFGQVLECWDRERKEMVAIKIVRGIKKYREAAMVEIEVLQQLGKHDKGSNRCVQIRNWFDYRNHICIVFEKLGPSLYDFLRKNSYRSFPIDLVREIGWQLLECVAFMHDLHMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGAASRESIKAVMKLPRLQNIIMQHVDHSAGDLIHLLQGLLRYDPFERLTARDALRHSFFTRDQLRR

SEQ ID NO: 14122 - protein, 430 aa, Glycine max
MEMERVFEFPHTYMDRRPRKRARLGWDIPEVPKAQVGLFCGQDVGTISSFAPSRGPSEHTTSSLFVKPVARNGSPPWRDDDKDGHYMFTLGENLTSRYKIHTKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGKQLLECIAFMHDLRMIHTDLKPENILLVSPEYVKVPDYKSSSRSSCSYFKRVPKSSAIKVIDFGSTTYEREDQNYIVSTRHYRAPEVILGLGWSYPCDIWSVGCILVELCTGEALFQTHENLEHLAMMERVLGSLPQTMMKRVDRHAEKYVRRGRLDWPEGATSRESIKAVMKLPRLQNLVMQHVDHSAGDLIHLLQGLLRYDPSERLTAKEALRHSFFMREHFRR

SEQ ID NO: 14123 - protein, 430 aa, Glycine max
MEMERVFEFPHTHMDRRPRKRARLGWDIPEVPKAQVGLFCGQDVGTISSFAPSRGPSENTTSSLFVKPVARNGSPPWRDDDKDGHYMFALGENLTSRYKIHSKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGGALFQTHENLEHLAMMERVLGPLPQPMLKRVDRHAEKYVRRGRLDWPEGATSRESIKAVMKLPRLQNLVMQHVDHSAGDLIHLLQGLLRYDPSERLTAKEALRHSFFMRDQFRR

SEQ ID NO: 14124 - protein, 430 aa, Vigna unguiculata
MEMERVFEFPHSHMDRRPRKRARLGWDIPEVPKAQVGLFCGQDVGAISSYAPSRGPSEHTTCSLFVKAVAQNGSPPWRDDDKDGHYMFALGDNLTSRYKIHSKMGEGTFGQVLECWDRERKEMVAIKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSTYFKRVPKSSAIKVIDFGSTTYERDDQTYIVSTRHYRAPEVILGLGWSYPCDIWSVGCILVELCTGEALFQTHENLEHLAMMERVLGPLPQHMLKRVDRNAEKYVRRGRLDWPEGATSRESIKAVMKLPRLQNLIMQHVDHSAGDLIHLLQGLLRFDPSERLTAKEALRYPFFMRDHFRR

SEQ ID NO: 14125 - protein, 430 aa, Cajanus cajan
MEMERVFEFPHTHMDRRPRKRARLGWDIAEVPKAQVGLFCGQDVGSISSYAPSRGPSEHTNSSLFVKAVARNGSPPWRDDDKDGHYMFALGENLTSRYKIHSKMGEGTFGQVLECWDRERKEMVAIKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGLGWSFPCDIWSVGCILVELCSGEALFQTHENLEHLAMMERVLGPLPQHMLKRVDRHAEKYVRRGRLDWPEGATTRDSIKAVMKLPRLQNLIMQHVDHSAGDLIHLLQGLLRYDPSERLTAKEALRHSFFMRDHFRR

SEQ ID NO: 14126 - protein, 429 aa, Lupinus angustifolius
MEMERVFEFPHTHMDRRPRKRARLGWDIPEVPKAQVGLFFGQEVENISSYAPSLGSSEYTTSSLFVKGVARNGSPPWREDDKDGHYMFAIGDNLTSRYKIHSKMGEGTFGQVLECWDREKKEMVAIKIVRGIKKYREAAMIEIEVLQQLGKHDKGGNRCVQLRNWFDYRNHICIVFEKLGPSLYDFLRKNNYRSFPIDVVREIGRQLLECVAFMHDLSMIHTDLKPENILLVSPEYVKVPDYKSSSRSPSSYFKRVPQSSAIKVIDFGSTTYERKDQNYIVSTRHYRAPEVILGLGWSYPCDVWSVGCILVELCTGEALFQTHENLEHLAMMERVLGALPQHMLKRIDRHAEKYVRKGRLDWPEGATSRDSIKAVMKLPRLQNLIMLHVDHSAGDLIHLLQGLLRFDPSERLTAKEALRHSFFRDHLRR

SEQ ID NO: 14127 - protein, 430 aa, Phaseolus vulgaris
MEMERVFEFPHSHMDRRPRKRARLGWDIPEVPKAQVGLFCGQDVGAISSYAPSRGPSEHTTCSLFVKAVAQNGSPPWRDDDKDGHYMFALGENLTSRYKIHSKMGEGTFGQVLECWDRERKEMVAIKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSTYFKRVPKSSAIKVIDFGSTTYEREDQTYIVSTRHYRAPEVILGLGWSYPCDIWSVGCILVELCTGEALFQTHENLEHLAMMERVLGPLPQHMLKRVDRNADKYVRRGRLDWPEGATSRESIKAVMKLPRLQNLVMQHVDHSAGDLIHLLQGLLRFDPSERLTAKEALRYPFFMRDHFRR

SEQ ID NO: 14128 - protein, 430 aa, Phaseolus vulgaris
MEMERVFEFPHTHMDRRPRKRARLGWDIPEAPKAQVELFCGQDVETISSYAPSSGPSEHTTSSLIVKAVAQNGSPSWRDDDKDGHYMFALGENLTSRYRIHSKMGEGTFGKVLECWDRERKEMVAIKIIRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPGSYFKKVPKSSAIKVIDFGSTTYEREDQNYIVSTRHYRAPEVILGLGWSYPCDIWSAGCILVELCTGEALFQTHENLEHLAMMERVLGPLPLHMLKRVDRHAEKYVRRGRLHWPDGATSRESIKAVMKLPRLQNLIMHHVDHSAGDLIHLLQGLLRFDPSERLTAKEALRHSFFMRDHFRR

SEQ ID NO: 14129 - protein, 411 aa, Arachis hypogaea
KRARLGWDIPEAPKAQVGLFCGQEVGTISSYAPSWGPSEHTSSSLSVKGVARNGSPPQRDDDKDGHYIFELGENLTSRYKIHSKMGEGTFGQVLECWDRERKEMVAIKIVRGVKKYREAAMIEIEVLQQLGKHDKGGNRCVQIRNWFDYRNHICIVFEKLGPSLYDFLRKNNYRSFPIDLVREIGRQLLECVAFMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGEALFQTHENLEHLAMMERVLGPLPQHMLKRVDRHAEKYIRRGRLDWPEGATSRDSIKAVMKLPRLQNLIMQHVDHSAGDLIHLLQGLLRYDPSERLTAREALRHSFFMRDYLRR

SEQ ID NO: 14130 - protein, 428 aa, Cicer arietinum
MEMERVFEFPHTHMDRRPRKRARLGWDVPEVPKAQVGLFFGQEVANISSYAPSGVPAENTTSSLFVKGVARNGSPPWRDDDKDGHYMFAVGENLTSRYKIHSKMGEGTFGQVLECWDRERKEMVAIKIVRGIKKYREAAMIEIEMLQQLGKHDIGGNRCVQIRNWFDYRNHICIVFEKLGPSLYDFLRKNNYRSFPIDLVREIGRQLLECIAFMHDLRMIHTDLKPENILLVSSDYVKVPDYKITSRSPNSYFKKVPKSCAIKVIDFGSTTYERVDQSYIVSTRHYRAPEVILGLGWSHPCDIWSVGCILVELCTGEALFQTHENLEHLAMMERVLGPLPLHMLKRVDRHAEKYVRRSKLDWPEGAASRESIKAVLKLPRLQNLIMQHVDHSAGDLIHLLQGLLRYDPSERLSAKEALRHSFFMRRSH

SEQ ID NO: 14131 - protein, 428 aa, Medicago truncatula
MEMERVFEFPHTHMDRRPRKRARLGWDVPETPKAQVELFFGQELGNISSYAPSGVPSEHTTSSLSVKGVARNGSPPWRDDDKDGHYTFAVGENLTSRYKIHSKMGEGTFGQVLECWDRERKEMVAIKIVRGIKKYREAAMIEIEMLQQLGKHDIGGNRCVQIRNWFDYRNHICIVFEKLGPSLYDFLRKNNYRSFPIDLVREIGRQLLECIAFMHDLRMIHTDLKPENILLVSPDYVKVPDYKISSRSPNSYFKKVPKSSAIKVIDFGSTTYERVDQSYIVSTRHYRAPEVILGLGWSHSCDIWSVGCILVELCTGEALFQTHENLEHLAMMERVLGPLPMHMLKRVDRHAEKYVRRGKLDWPVGATSRESIKAVMKLPRLQNLIMQHVDHSAGDLIHLLQGLLRYDPSERITAKEALRHSFFMRRSH

SEQ ID NO: 14132 - protein, 433 aa, Unknown
  Sequence found in Organisms: Citrus clementina, Citrus sinensis
MEMERVTEFPFSNLDRRPRKRARLGWDVPQVPKAQVGLFCGQEVGNVTSFAPPRAPSDHVTSSSLFVKGVARNGSPPWREDDKDGHYMFALGENLTSRYKIHSKMGEGTFGQVLECWDRERKEMVAIKIVRGIKKYREAAMIEIEVLQQLAKHDKGGNRCVQIRNWFDYRNHICIVFEKLGSSLYDFLRKNNYRSFPIDLVREIARQLLECIAFMHDLCMIHTDLKPENVLLVSSEYIKVPDYKSSLHTPKDSSYFKRMPKSSAIKVIDFGSTTYERPDQNYIVSTRHYRAPEVILGLGWTYPCDIWSVGCILVELCTGEALFQTHENLEHLAMMERVLGPLPQHMLKRVDRHAEKYVRRGRLDWPEGAASRESIKSVMKLPRLQNLIMQHVDHSAGDLTHLLQGLLRYDPTDRLTAREALRHPFFTRDHLRR

SEQ ID NO: 14133 - protein, 433 aa, Manihot esculenta
MEMERVTEFPLAHLDRRPRKRARLGWDVSQVPKAQVGIFCGQEVGSITSYASSGATPDHIISSSLFVKGVARNGSPPWREDDKDGHYMFAIGENLTSRYKIHSKMGEGTFGQVLECWDRERKEMVAIKIVRGIKKYREAAMIEIEVLQQLGKHDKGGNRCVQIRNWFDYRNHICIVFEKLGPSLYDFLRKNNYRSFPIDLVREIGRQLLECVAFMHDLHLIHTDLKPENILLVSADYIKVLDYKGSSRAPKESSYLKRVPKSSAIKVIDFGSTTYERQDQNYIVSTRHYRAPEVILGLGWSYPCDIWSVGCILVELCTGEALFQTHENLEHLAMMERVFGPLPQHMLKRIDRHAEKYIRRGRLDWPEGATSRESIKAVLKLPRLQNLVMQHVDHSAGDLIHLLQGLLRYEPSDRLTAREALRHPFFTGDHLRR

SEQ ID NO: 14134 - protein, 435 aa, Vitis vinifera
MEMVERVTEFPHTHMDRRPRKRPRLGWDVLPQAPKAQLGMFCGQEVGNVASFAPSKAHSDQTTSSMFVKGVARNGSPPWREDDKDGHYIFALGENLTSRYKINSKMGEGTFGQVLECWDRERKEMVAVKIVRGIKKYREAAMIEIEVLQQLAKHDKGGNRCVQIRNWFDYRNHICIVFEKLGPSLYDFLRKNNYRSFPIDLVREIGRQLLECVAFMHDLRLIHTDLKPENILLVSPEYVKVPDYKVSSRSPKDGSYFKRVPKSSAIKVIDFGSTTYERQDQNYIVSTRHYRAPEVILGLGWSYPCDIWSVGCILVELCTGEALFQTHENLEHLAMMERVLGPLPQHMLKRVDRHAEKYVRRGRLDWPEGATSRESIKAVLKLPRLQNLIMQHVDHSAGDLIHLLQGLLRYDPSDRLTAIGALRHPFFTRDHLRRS

SEQ ID NO: 14135 - protein, 435 aa, Ricinus communis
MEMERVTEFPLPHLDRRPRKRARLGWDVPLVPKAQVGMFCAQEVGNVASYASSGANSDHTTTSSSVFLKGVAPRNGSPPWREDDKDGHYMFALGENLTSRYKIHSKMGEGTFGQVLECWDRERKEMVAIKIVRGIKKYREAAMIEIDVLQQLGKHDKGGNRCVQIRNWFDYRNHICIVFEKLGPSLYDFLRKNNYRSFPIDLVREIGRQLLECIAFMHDLHLIHTDLKPENILLVSPDYVKVPDYKGSTRSPKDSSYFKRVPKSSAVKVIDFGSTTYERQDQNYIVSTRHYRAPEVILGLGWSYPCDIWSVGCILVELCTGEALFQTHENLEHLAMMERVLGPLPQHMLKRIDRHAEKYVRRGRLDWPEGATSRESIKAVLKLPRLQNLVMQHVDHSAGDLIHLLQGLLRYDPSDRLTAREALRHPFFARDHLRR

SEQ ID NO: 14136 - protein, 428 aa, Trigonella foenum-graecum
MEMERVFEFPHTHMDRRPRKRARLGWDVPETPKAQVGLFCGQELGNISSYAPSGVPPEHTPSSLSVKGVARNGSPPWRDDDKDGHYTFAVGENLTSRYKIHSKMGEGTFGQVLECWDRERKEMVAIKIVRGIKKYREAAMIEIEMLQQLGKHDIGGNRCVQIRNWFDYRNHICIVFEKLGPSLYDFLRKNNYRSFPIDLVREIGRQLLECIAFMHDLRMIHTDLKPENILLVSPDYVKVPDYKISSRSPNSYFKKVPKSSAIKVIDFGSTTYERVDQSYVVSTRHYRAPEVILGLGWSHPCDIWSVGCILTELCTGEALFQTHENLEHLAMMERVLGPLPMHMLKRVNRHAEKYVRRGKLDWPLGATSRESIKAVTKLPRLQNLIMQHVDHSAGDLIHLLQGLLRYDPSERITAKEALRHSFFMRRSH

SEQ ID NO: 14137 - protein, 81 aa, Quercus alba
MEMERVTEFPHTHMDRRPTKRARLGWDVLPQPSKAQVGMFCGQEVGSLTSFAPSRAPSDLTTNSSLYEKGVARNGSPPKAR

SEQ ID NO: 14138 - protein, 431 aa, Cichorium intybus
MEMERVTEFPMGQLDLRPRKRQRLGWDVVPQPPKAQLGLFCGQEIGNVASFAPSSDNISSPLVKRVARNASPPWRQDDKDGHYVFALGDNLTSRYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYRSFPIDLVREIGRQLLECIAFMHDLRLIHTDLKPENILLVSPEYVKVPDYKGSSRSPKDGYFSKRVPKSSAIKVIDFGSTTYDRQDQSYIVSTRHYRAPEVILGLGWSYPCDIWSVGCILVELCSGEALFQTHENLEHLAMMERVLGALPTSMLKKADRHAEKYVRKGRLDWPEGATSRESIKAVMKLPRLQNLIMQHVDHSAGDLIHLLQGLLRYDPSERLTARAALRHPFFTRDHLSRRY

SEQ ID NO: 14139 - protein, 432 aa, Panax ginseng
MEMERVVEFPHAHMDRRPRKRQRLGWDVVPQPPKAQLGLFCGQEVGNVTSFASKAPTDHTSSSLLVKGVARNGSPPWREDDKDGHYMFAVGDNLTSRYKIFSKMGEGTFGQVLECWDKERKEMVAIKVVRGIKKYREAALIEVDVLQQLGKNDKAGNRCVQIRNWFDYRNHICIVFEKLGPSLYDFLRKNNYRSFPIDLVREIGRQLLDCVAFMHDLHLIHTDLKPENILLVSPEYIKVPDYKGSSRLPMDGSYFKRVPKSSAIKVIDFGSTTYDRQDQTYIVSTRHYRAPEVILGLGWSYPCDVWSVGCILVELCSGEALFQTHENLEHLAMMERVLGPIPQHMLKRVDRHAEKYARKGKLDWPEGAASRESIKAVLKLPRLQNLIMQHVDHSAGDLIHLLQGLLRYDPSERSTAREALRHPFFTRDDLRR

SEQ ID NO: 14140 - protein, 432 aa, Fragaria vesca
MEMERVVEFPHTHMDRRPRKRARLGWDVPQAPKAQVGMYCGQEVGNMTSFTPLMAPSLYTSSLFDKEVARNGSPPWREDDKDGHYMFSVGENLTARYKIQSKMGEGTFGQVLECWDREKKEMVAIKIVRGIKKYREAAMIEIEMLQQLGKHDKGGSRCVQLRNWFDYRNHICIVFEKLGPSLYDFLKKNNYRSFPIDLVREIGRQLLECVAFMHDLSLIHTDLKPENILLVSPDYIRVPDYNKSSSRSPKDSSYYKRVPKSSAIKVIDFGSTTYERQDQNYIVSTRHYRAPEVILGMGWSYPCDVWSIGCILVELCTGEALFQTHENLEHLAMMERVLGPLPQHMLKRADRHAEKYVRRGRLDWPEGAASRESIKAVQKLARLQNLIMQHVDHSAGDLIHLLQGLLKYDPSDRLTAREALRHSFFTRDNLRR

SEQ ID NO: 14141 - protein, 437 aa, Arnica chamissonis
IASDYGDGTCYGVPMSQLDLRPRKRQRLGWDVAPPPPKAQLGLFCGQEIGNVTSFASLGAPSDHISSSILKRVARNLSPPWRQDDKDGHYVFAVGDNLTARYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYSSFPIDLVREIGRQLLECIAFMHDLRLIHTDLKPENILLVSPEYVKVPDYKGSSRSPKDGSYSKRVPKSSAIKVIDFGSTTYDRQDQTYIVSTRHYRAPEVILGLGWSYPCDIWSVGCILVELCTGEALFQTHENLEHLAMMERVLGLLPTHMLKKSDRHAEKYVRKGRLDWPEGSTSRESIKAVMKLPRLQNLIMQHVDHSAGDLIHLLQGLLRYDPSERLTARAALRHPFFTRDHLRRY

SEQ ID NO: 14142 - protein, 432 aa, Platanus occidentalis
MEMECLTEFPHTHMDRRPRKRPRLAWDVPQAPKAQPGIFCGQEVGNLTSFAPSRAPSDHTSSLFVKGVARNGSPPWRDDDKDGHYIFALGENLTSRYRIHSKMGEGTFGQVLECWDRERKEMVAIKIVRGIKKYREAAMIEIEVLQQLGKHDKGGSRCVQIRNWFDYRNHICIVFEKLGPSLYDFLRKNNYRSFPIDLARELGRQLLECVAFMHDLHLIHTDLKPENILLVSPEYIKVPDYKVSSRSPKDGSYFKRLPKSSAIKVIDFGSTTYEHQDHSYIVSTRHYRAPEVILGLGWSYPCDIWSVGCILVELCSGEALFQTHENLEHLAMMERVLGPIPQHMLKRVDRHAEKYVRRGRLDWPEGATSRESIKAVLKLPRLQNLVMQHVDHSAGDLIDLLQGLIKYDPVDRLTAREALRHPFFTRDQHRRS

SEQ ID NO: 14143 - protein, 427 aa, Populus trichocarpa
MELEHVTVIPITHLDRPRKRARFGWDVPQAQVGIFCGQEVGNVASYASSGAISDHTSSLFVKGVARNGSPPWREDDKDGHYMFALGDNLTSRYKIHSKMGEGTFGQVLECWDRERKEMVAIKIVRGIKKYREAAMIEIEVLQNLGKHDKGSNRCVQIRNWFDYRNHICIVFEKLGPSLYDFLRKNNYRSFPIDLVREIGRQLLECVAFMHDLRMIHTDLKPENILLVSSDYVKVPDYKNSSRSPKDISYYKRVPKSSAIKVIDFGSTTYERQDQNYIVSTRHYRAPEVILGLGWSYPCDIWSVGCILVELCTGEALFQTHENLEHLAMMERVLGPMPQHILKRVDRHAGKYVRRGRLDWPEGAASRESMKAVLKLPRLQNLVMQHVDQSAGDLIHLLQGLLRYDPLDRLTAREALRHPFLAKVQHRR

SEQ ID NO: 14144 - protein, 434 aa, Lactuca sativa
MEMERVTEFPMGQLDLRPRKRQRLGWDVVPPPPKAQLGLFCGQEIGNVASFAPQRAPSDHISSPLVKRVARNASPPWCQDDKDGHYVFALGDNLTSRYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYRSFPIDLVREIGRQLLECIAFMHDLRLIHTDLKPENILLVSPEYVKVPDYKGSSRSPKDSSFSKRVPKSSAIKVIDFGSTTYDRQDQSYIVSTRHYRAPEVILGLGWSYPCDIWSVGCILVELCSGEALFQTHENLEHLAMMERVLGPLPTHMLKKADRHAEKYVRKGRLDWPEGATSRESIKAVMKLPRLQNLIMQHVDHSAGDLIHLLQGLLRYDPLERVTARAALRHPFFTRDNLSRRY

SEQ ID NO: 14145 - protein, 433 aa, Centaurea maculosa
MEMERVTEFPMTQLDIRPRKRQRLGWDVVPQPPKAQLGLFCGQEIGNLTSFAPSRAPSDHINSSLVKRVARIGSPPWRQDDKDGHYVFAVGDNLTSRYKIHGKMGEGTFGQVLECWDKERKEMVAIKIVRGIKKYREAAMIEIDVLQQLGKHDKGGNRCVQLRNWFDYRNHICIVFEKLGPSLYDFLRKNNYRSFPIDLVREIGRQLLECIAFMHDLRLIHTDLKPENILLVSGEYLKVPDYKCSSRSPKDGSFSKRIPKSSAIKVIDFGSTTYDRHDQNYIVSTRHYRAPEVILGLGWSYPCDIWSVGCILVELCSGEALFQTHENLEHLAMMERVLGPLPMHMLKKADRHAEKYVRKGRLDWPEGAGSRESIKAVMKLPRLQNLIMQHVDHSAGDLIHVLQGLLRYDPSERLTAHAALRHPFFTRDHFRRY

SEQ ID NO: 14146 - protein, 433 aa, Unknown
  Sequence found in Organisms: Centaurea maculosa, Cirsium arvense
MEMERVTEFPMTQLDIRPRKRQRLGWDVVPQPPKAQLGLFCGQEIGNLTSFAPTRAPSDHISSSLVKRVARIGSPPWRQDDKDGHYVFAVGDNLTSRYKIHGKMGEGTFGQVLECWDKERKEMVAIKIVRGIKKYREAAMIEIDVLQQLGKHDKGGNRCVQLRNWFDYRNHICIVFEKLGPSLYDFLRKNNYRSFPIDLVREIGRQLLECIAFMHDLRLIHTDLKPENILLVSGEYLKVPDYKGSSRSPKDGSFSKRIPKSSAIKVIDFGSTTYDRHDQNYIVSTRHYRAPEVILGLGWSYPCDIWSVGCILVELCSGEALFQTHENLEHLAMMERVLGPLPMHMLKKADRHAEKYVRKGRLDWPEGAGSRESIKAVMKLPRLQNLIMQHVDHSAGDLIHVLQGLLRYDPSERLTAHAALRHPFFTRDHFRRY

SEQ ID NO: 14147 - protein, 433 aa, Cirsium arvense
MEMERVTEFPMTQLDIRPRKRQRLGWDVVPQPPKAQLGLFCGQEIGNLTSFAPSRAPSDHINSSLVKRVARIGSPPWRQDDKDGHYVFAVGDNLTSRYKIHGKMGEGTFGQVLECWDKERKEMVAIKIVRGIKKYREAAMIEIDVLQQLGKHDKGGNRCVQLRNWFDYRNHICIVFEKLGPSLYDFLRKNNYRSFPIDLVREIGRQLLECIAFMHDLRLIHTDLKPENILLVSGEYLKVPDYKGSSRSPKDGSFSKRIPKSSAIKVIDFGSTTYDRHDQNYIVSTRHYRAPEVILGLGWSYPCDIWSVGCILVELCSGEALFQTHENLEHLAMMERVLGPLPMHMLKKADRHAEKYVRKGRLDWPEGAGSRESIKAVMKLPRLQNLIMQHVDHSAGDLIHVLQGLLRYDPSERLTAHAALRHPFFTRDHFRRY

SEQ ID NO: 14148 - protein, 433 aa, Cirsium arvense
MEMERVTEFPMSQLDIRPRKRQRLGWDVVPQPPKAQLGLFCGQEIGNLTSFAPSRAPSDHISSSLVKRVARIGSPPWRQDDKDGHYVFAVGDNLTSRYKIHGKMGEGTFGQVLECWDKERKEMVAIKIIRGIKKYREAAMIEIDVLQQLGKHDKGGNRCVQLRNWFDYRNHICIVFEKLGPSLYDFLRKNNYRSFPIDLVREIGRQLLECIAFMHDLRLIHTDLKPENILLVSREYLKVPDYKCSSRSPKDGSFSKRIPKSSAIKVIDFGSTTYDRQDQNYIVSTRHYRAPEVILGLGWSYPCDIWSVGCILVELCSGEALFQTHENLEHLAMMERVLGPLPMHMLKKADRHAEKYVRKGRLDWPEGAGSRESIKAVMKLPRLQNLIMQHVDHSAGDLIHVLQGLLRYDPSERLTAHAALRHPFFTRDHLRRY

SEQ ID NO: 14149 - protein, 430 aa, Tragopogon dubius
MEMERVTEFPMGQLDLRPRKRQRLGWDVVAPPPKAQVGLFCGQEIGNVTGFAPQLDHISSPLVKRVARNDSPPWRQDDKDGHYVFALGDNLTSRYKIHGKMGEGTFGQVLECWDKERKEMVAIKIVRGIKKYREAAMIEIDVLQQLGKHDKGGNRCVQLRNWFDYRNHICIVFEKLGPSLYDFLRKNNYRSFPIDLVREIARQLLECIAFMHDLRLIHTDLKPENILLVSSEYLKVSDYKGSSRSPKDGSYSKRVPKSSAIKVIDFGSTTYDRQDQSYIVSTRHYRAPEVILGLGWSYPCDIWSVGCILVELCSGEALFQTHENLEHLAMMERVLGPLPTHMLKKADRHAEKYVRKGRLDWPEGATSRESIKAVMKLPRLQNLIMQHVDHSAGDLIHLLQGLLRHDPLERLTASEALRHPFFTRDHLRRY

SEQ ID NO: 14150 - protein, 433 aa, Malus domestica
METERVTEFPFAHLDRRPRKRARLGWDVPQAPKAQVGIFCGQELGNVTSFASFVAPAEPTTISLFDKEVARNGSPPWREDDKDGHYMFSLGENLTSRYKIQSKMGEGTFGQVLECWDRERKEMVAIKIVRGIKKYREAAMIEIEVLQQLGKHDKGGNRCVQLRNWFDYRNHICIVFEKLGPSLYDFLKKNNYRSFPIDLVREIGRQLLECVAFMHDLRLIHTDLKPENILLVSQDYIKVPDYNKSSSRSPKDSSYFKRIPKSSAIKVIDFGSTTYERQDQTYIVSTRHYRAPEVILGLGWTYPCDVWSIGCILVELCTGEALFQTHENLEHLAMMERVLGPLPQHMLKRADRHAEKYVRRGRLDWPEGAASRESIRAVQKLPRLQNLIMQHVDHSAGDLIHLLQGLLRYDPSDRLSAREALRHSFFTKDSLRR

SEQ ID NO: 14151 - protein, 425 aa, Unknown
  Sequence found in Organisms: Brassica napus, Brassica rapa
MEMERVHEFPHTHMDRRPRKRARLGWDVLPTAPKAQVGMFCGQEIGNLSSFGAPSEISSSSLSVKTVARNDSPPWREDDKDGHYMFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVSYKRVPKSSAIKVIDFGSTTYERQEQSYIVSTRHYRAPEVILGLGWSYPCDVWSIGCIIVELCTGEALFQTHENLEHLAMMERVLGPLPQQMLKKVDRHAEKYVRRGRLDWPDGATSRDSLKAVLKLPRLQNLIMQHVDHSAGDLINMVQGLLRFDPAERLTAREALRHPFFARRR

SEQ ID NO: 14152 - protein, 437 aa, Mesembryanthemum crystallinum
MEMERVTEFPLTHHLDRRRRKRARLGWDVAPQISKAQIGIFCGQEVGNVTSFAPSAAPSEHTTTTSSLFSKGVARNGSPRQGGMMTKMGITCLSFGENLTSRYKIHGKMGEGTFGQVLECWDRERKEMVAIKIVRGIKKYREAAMIEIDVLQQLGKHDKGGSRCVQIRNWFDYRNHICIVFEKLGSSLYDFLRKNNYGPFPIDLVRENGRQLLDCVAFMHDLHLIHTDLKPENVLLVSSDYVKIRDYKGFSRSPKDSSYYKKVPKSSAIKVIDFGSTTYERPDQNYIVSTRHYRAPEVILGLGWSYPCDVWSVGCILVELCSGEALFQTHENLEDLAMMERVLGPLPQHMLKRVDRHAEKYVRRGRLDWPEGAASRESIRAVTKLLRLQNLVMQHVDHSGGDFIHLLQGLLRYDPSDRLTAREAVRHPFFTRDNLRR

SEQ ID NO: 14153 - protein, 433 aa, Malus domestica
METERVTEFPFAYLDRRPRKRARLGWDVPQAPKAQVGMFCGQELGNVTSYASLMAPSETSTISLFDKEVTRNGSPPWREDDKDGHYMFSLGENLTTRYKIQSKMGEGTFGQVLECWDREKREMVAIKIVRGIKKYREAAMIEIEVLQQLGKHDKGGNRCVQLRNWFDYRNHICIVFEKLGPSLYDFLKKNNYRSFPIDLVREIGRQLLECVAFMHDLRLIHTDLKPENILLVSQDYIKVPDYNKSSSRSPKDSSYFKRVPKSSAIKVIDFGSTTYERQDQTYIVSTRHYRAPEVILGLGWTYPCDVWSIGCILVELCTGEALFQTHENLEHLAMMERVLGSLPQHMLKRADRHAEKYVRRGRLDWPEGAASRESIRAVQKLPRLQNLIMQHVDHSAGDFIHLLQGLLRYDPSDRLSAREALRHSFFTKDSLRR

SEQ ID NO: 14154 - protein, 425 aa, Brassica napus
MEMERVHEFPHTHMDRRPRKRARLGWDVLPTAPKAQVGMFCGQEIGNLSSFGAPSEISSSSLSVKTVARNDSPPWREDDKDGHYMFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVSYKRVPKSSAIKVIDFGSTTYERQEQSYIVSTRHYRAPEVILGLGWSYPCDVWSIGCIIVELCTGEALFQTHENLEHLAMMERVLGPLPQQMLKKVDRHAEKYVRRGRLDWPDGATSRDSLKAVLKLPRLQNLIMQHVDHSAGELINMVQGLLRFDPAERLTAREALRHPFFARRR

SEQ ID NO: 14155 - protein, 427 aa, Arabidopsis lyrata
MEMERVHEFPHTNMDRRPRKRARLGWDVLPQATKAQVGMFCGQEIGNLSSFPSSGAPSDNSSSLCVKGVARNGSPPWREDDKDGHYMFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVCYKRVPKSSAIKVIDFGSTTYERQDQTYIVSTRHYRAPEVILGLGWSYPCDVWSIGCIIVELCTGEALFQTHENLEHLAMMERVLGPFPQQMLKKVDRHAEKYVRRGRLDWPDGATSRDSLKAVLKLPRLQNLIMQHVDHSAGELINMLQGLLRFDPAERLTAREALRHPFFARRR

SEQ ID NO: 14156 - protein, 434 aa, Nicotiana benthamiana
MEMERVTEFPLTHHLDRRPRKRARLGWDVLPVEPPKAQLGLFFGQEVGNVTSYAPSRKLTDLTCTPFIKGVTQNGSPPWREDDKDGHFVFELGENLTSRYKIHSKMGEGTFGQVLECWDRERKEMVAIKIVRGMKKYRDAAMIEVEMLQQLGKHDKGGNRCVQIRNWFDYRNHICIVFEKLGPSLYDFLRKNNYRSFPIDLVREIGRQLLECIAFMHDLRLIHTDLKPENILLNSSEYVKVPDYKVSSRSPKDGSYYKRIPKSSAIKVIDFGSTTYDRQNQTYIVSTRHYRAPEVILGLGWSYQCDIWSVGCILVELCSGEALFQTHENLEHLAMMEKVLGPLPQHILKRVDRQAEKYVRRGRLDWPEGATSRDSIKAVLKLARLQNIVMKHVDHSAGDLINLLQGLLRYDPSERLTAREALRHPFFTRDHLRR

SEQ ID NO: 14157 - protein, 431 aa, Eutrema parvulum
MEMERVREFPHTHMDRRPRKRARLGWDVLPSAPKAQVGMFCGQEIGNMSSFASSGAPADISSTSLCVKGVARNDSPPWREDDKDGHYMFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVCYKRVPKSSAIKVIDFGSTTYERQDQNYIVSTRHYRAPEVILGLGWSYPCDIWSIGCIIVELCTGEALFQTHENLEHLAMMERVLGPFPQQMLKKVDRHAEKYVRRGRLDWPDGATSRDSLKAVLKLPRLQNLIMQHVDHSAGELINMVQGLLRFDPAERLTAREALRHPFFTRSHLRR

SEQ ID NO: 14158 - protein, 432 aa, Panax ginseng
MEMERVVEFPHAHMDRRPRKKQRLGWDVVPQAPKAQLGLFCGQEVGNVTSFASKAPTDHTSSSLLVKGVARNGSPPRREDDKDGHYMFAVGDNLTSRYKIFSKMGEGTFGQVLECWDKERKEMVAIKVVRGIKKYREAALIEVDVLQQLGKNDKAGNRCVQIRNWFDYRNHICIVFEKLGPSLYDFLRKNNYRSFPIDLVREIGRQLLDCVAFMHDLRLIHTDLKPENILLVSPEYIKVPDYKGSSRLPMDGSYFKRVPKSSAIKVIDFGSTTYDRQDQTYIVSTRHYRAPEVILGLGWSYPCDVWSVGCILVELCSGEALFQTHENLEHLAMMERVLGPIPQHMLKRIDRHAEKYARKGKLDWPEGAASRESIKAVLKLPRLQNLIMQHVDHSAGDLIHLLQGLLRYDPSERSTAHEALRHPFFTRDNLRR

SEQ ID NO: 14159 - protein, 441 aa, Theobroma cacao
MEMERVTEFPHTHMDRRPRKRPRLGWDVTQLPPQAQVGMFCAQEVGNLTSFASSTARAPSDYTSTITTSSSLVVKGGVARNGSPPWREDDKDGHYMFELGDNLTSRYKIQSKMGEGTFGQVLECWDRETKDVVAIKIVRGIKKYREAAMIEIEMLQQLGKHDKGGNRCVQIRNWFDYRNHICIVFEKLGPSLYDFLRKNNYRSFPIDLVREIGRQLLECVAFMHDLHLIHTDLKPENILLVSPEYVKVPDYKSTSRSPKDNSYFKRLPKSSAIKVIDFGSTTYERQDQTYIVSTRHYRAPEVILGLGWSYPCDIWSVGCILVELCTGEALFQTHENLEHLAMMERVLGPLPQHMLKRVDRHAEKYVRRCRLDWPDGATSSGSIKAVLKLPRLQNLIMQHVDHSAGDLIHLLQGLLRYDPIDRLTAREALRHPFFSRDQFRR

SEQ ID NO: 14160 - protein, 427 aa, Arabidopsis thaliana
MEMERVHEFPHTHMDRRPRKRARLGWDVLPQATKAQVGMFCGQEIGNISSFASSGAPSDNSSSLCVKGVARNGSPPWREDDKDGHYIFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVCYKRVPKSSAIKVIDFGSTTYERQDQTYIVSTRHYRAPEVILGLGWSYPCDVWSVGCIIVELCTGEALFQTHENLEHLAMMERVLGPFPQQMLKKVDRHSEKYVRRGRLDWPDGATSRDSLKAVLKLPRLQNLIMQHVDHSAGELINMVQGLLRFDPSERITAREALRHPFFARRR

SEQ ID NO: 14161 - protein, 434 aa, Nicotiana benthamiana
MEMERVTEFPLTHHLDRRPRKRARLGWDVLPAEPPKAQLGLFYGQEVGNVTSYAPSRQLTDLTCTPFIKGVTQNGSPPWREDDKDGHFVFELGENLTSRYKIHSKMGEGTFGQVLECWDRERKEMVAIKIVRGMKKYRDAAMIEVEMLQQLGKHDKGGNRCVQIRNWFDYRNHVCIVFEKLGPSLYDFLRKNNYRSFPIDLVREIGRQLLECIAFMHDLRLIHTDLKPENILLNSAEYVKVPDYKVSSRSPKDGSYYKRIPKSSAIKVIDFGSTTYDCQNQTYIVSTRHYRAPEVILGLGWSYPCDIWSVGCILVELCSGEALFQTHENLEHLAMMEKVLGPLPQHMLKRVDRQAEKYVRRGRLDWPEGATSRDSIKAVLKLARLQNIIMQHVDHSAGDLINLLQGLLRYDPSERLTAHEALRHPFFTRDHLRR

SEQ ID NO: 14162 - protein, 433 aa, Helianthus annuus
MEMERVTEFPMSQLDLRPRKRQRLGWDVAPLTPKAQVGLFCGQEIGDVPSFALSGAPSDYISSSILKRVARNVSPPWRQDDKDGHYVFAVGDNLTTRYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYSSFPIDLVREIGRQLLDCIAFMHELRLIHTDLKPENVLLVSSEYLKVPDYKGSSRSPKDGSFSKRVPKSSAIKVIDFGSTTYDRQDQSYIVSTRHYRAPEVILGLGWSYPCDIWSVGCILVELCTGEALFQTHENLEHLAMMERVFGPLPNHMLRKTDRHAEKYVRKGRLDWPEGAASRESIKAVTKLPRLQNLIMQHVDHSAGDLIHLLQGLLRYNPSERLTARAALRHPFFTRDHLRRY

SEQ ID NO: 14163 - protein, 432 aa, Aquilegia formosa
MEMECPPTEFPHTTHMMDRRPRKRPRLGWDVPQLPKAQIGMFCGQDVGNVTSYAPSDHTSSLFVKGVARNGSPPWRDDDKDGHYMFALGDNLTSRYKIHSKMGEGTFGQVLECWDRERKEFVAIKIVRGIKKYREAAMIEIDVLQQLAKHDKSGARCVQIRNWFDYRNHICIVFEKLGPSLYDFLRKNNYRSFPIDLVRELGRQLLECVAFMHDLRLIHTDLKPENILLVSPDYVKIPDYKVSPRSPKDGAYFKRLPKSSAIKVIDFGSTTYEHQDHSYIVSTRHYRAPEVILGLGWSYSCDVWSIGCILVELCSGEALFQTHENLEHLAMMERVLGPLPQHMLKRVDRHAEKYVRRGRLDWPEGATSRESIKAVTKLPRLQNLVMQHVDHSGGDFINLLQGLLRYDPSDRLTAKEALRHPFFTRDVHRRSS

SEQ ID NO: 14164 - protein, 433 aa, Prunus persica
METERVTEFPFTHLDRRPRKRARLGWDVPQAPKAQVGMFCGQELGNVTSFASLMAPSDHTTISLFDKEVARNGSPPWREDDKDGHYVFSLGENLTSRYKIQSKMGEGTFGQVLECWDREKKEMVAIKIVRGVKKYREAAMIEIEVLQQLGKHDKGGNRCVQLRNWFDYRNHICIVFEKLGPSLYDFLKKNNYRSFPIDLVREIGRQLLECVAFMHDLRLIHTDLKPENILLVSHDYSKVPDYNKNSSRSPKDSSYFKRIPKSSAIKVIDFGSTTYERQEQNYIVSTRHYRAPEVILGMGWTYPCDVWSIGCILVELCTGEALFQTHENLEHLAMMERVLGPLPQHILKRADRHAEKYVRRGRLDWPEGAASRESIRAVQKLPRLQNLVMQHVDHSAGDLIHLLQGLLRYDPSDRLSAREALRHSFFTKDNLRR

SEQ ID NO: 14165 - protein, 457 aa, Gossypium raimondii
MEMERVTGFPHTHMDRRPRKRPRLGWDVTQLPPQAQVGMFCAQEVGRVTGFASSTAKAPADYASTITTSSSVVLKGGVAQNGSPPWRDDDKDGHYMFELGDNLTSRYKIQSKMGEGTFGQVLECWDRERKEMVAIKIVRGIKKYREAAMIEIEMLQQLRKHDKGGNRCVQIRNWFDYRNHICIVFEKLGPSLYDFLRKNNYRSFPIDLVREIGRQLLECVAFMHDLNLIHTDLKPENILLVSPEYVKIPDYKGTLRSPKDSYFRRLPKSSAIKVIDFGSTTYERPDQNYIVSTRHYRAPEVILGLGWSYACDIWSVGCILVELCTGEALFQTHENLEHLAMMERVLGPLPQHMLKRVDRHAEKYVRRGRLDWPDGATSRESIKAVLKLPRLQNLIMQHVDHSAGDLIHLLQGLLRYDPIDRLTAREALRHPFFSRDQFRRLSLAGIGWPGMNEYLRK

SEQ ID NO: 14166 - protein, 330 aa, Ambrosia trifida
MGEGTFGQVLECWDKERKEMVAIKVVRGIKKYREAAMIEIDMLQQLGKHDKGGNRCVQIRNWFDYRNHICIVFEKLGPSLYDFLRKNNYSSFPIDLVREIGRQLLDCIAFMHELRLIHTDLKPENVLLVSPEYVKVPDYKGSSRSPKDGSFSKRVPISSAIKVIDFGSTTYDRQDQNYIVSTRHYRAPEVILGLGWSYPCDIWSVGCILVELCTGEALFQTHENLEHLAMMERVFGPLPNHMLRKSDRHAEKYVRKGRLDWPEGAASRESIKAVTKLPRLQNLIMQHVDHSAGDLIHLLQGLLRYDPSERLTARAALRHPFFTRDHFRRY

SEQ ID NO: 14167 - protein, 265 aa, Helianthus annuus
MEMERVTEFPMSQLDLRPRKRQRLGWDVAPLTPKAQVGLFCGQEIGDVPSFALSGAPSDYISSSILKRVARNVSPPWRQDDKDGHYVFAVGDNLTTRYKIHGKMGEGTFGQVLECWDKERKEMVAIKIVRGIKKYRDAAMIEIDVLQQLGKHDKGGNRCVQIRNWFDYRNHICIVFEKLGPSLYDFLRKNNYSSFPIDLVREIGRQLLDCIAFMHELRLIHTDLKPENVLLVSSEYLKVPDYKGSSRSPKDGSFSKRSQNQVPLK

SEQ ID NO: 14168 - protein, 428 aa, Euonymus alatus
MEMERVTGFPLDRRPRKRARLGWDVPQVPKAQVGIFCAQEVGNVISFASSRAPSDIIPSSLFVKGVDRNGSPPWREDDKDGHYVFAVGDNLTSRYKIHSKMGEGTFGQVLECWDRERGEMVAIKVVRGIKKYRDAAMIEIEVLQQLGRHDKGNRCVQIRNWFDYRNHICIVFEKLGPSLYDFLRKNNYRSFPIDLVREIGRQLLESVAFMHELRLIHTDLKPENILLVSPDYVKVPDYKSSSRSPRDGSYFKRVPKYSSIKVIDFGSTTYERQDQSYVVSTRHYRAPEVILGLGWSYPCDVWSVGCILVELCTGEALFQTHENLEHLAMMERVLGPLPHHILKKIDRHSEKYVRRGRLDWPEGATSRDSIRAVSKLPRLQNLIMQHVDHSAGDLIHLLQCLLRYDPTERLAAHNALKHPFFMREHQRR

SEQ ID NO: 14169 - protein, 65 aa, Flaveria ramosissima
MEMERVTEFPMSQLDLRPRKRQRLGWDVAPAPTKAQVGLFCAQEIGNVTSFAPLGPQQTILVHPS

SEQ ID NO: 14170 - protein, 210 aa, Raphanus sativus
MEMERVHEFPHTHMDRRPRKRARLGWDVLPPAPKAQVGMFCGQEIGNMSSFGAPSSEISSSTSLSVKTVARNDSPPWREDDKDGHYMFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKTIIAPFPLILSVRLAGNSWNV

SEQ ID NO: 14171 - protein, 457 aa, Gossypium raimondii
MEMERVTGFPHTHMDRRPRKRPRLGWDVTQLPPQAQVGMFCAQEVGRVTGFASSTAKAPADYASTITTSSSVVLKGGVAQNGSPPWRDDDKDGHYMFELGDNLTSRYKIQSKMGEGTFGQVLECWDRERKEMVAIKIVRGIKKYREAAMIEIEMLQQLRKHDKGGNRCVQIRNWFDYRNHICIVFEKLGPSLYDFLRKNNYRSFPIDLVREIGRQLLECVAFMHDLNLIHTDLKPENILLVSPEYVKVPDYKGTLRSPKDSYFRRLPKSSAIKVIDFGSTTYERPDQNYIVSTRHYRAPEVILGLGWSYACDIWSVGCILVELCTGEALFQTHENLEHLAMMERVLGPLPQHMLKRVDRHAEKYVRRGRLDWPDGATSRESIKAVLKLPRLQNLIMQHVDHSAGDLIHLLQGLLRYDPIDRLTAREALRHPFFSRDQFRRLSLAGIGWPGMNEYLRK

SEQ ID NO: 14172 - protein, 457 aa, Gossypium hirsutum
MEMERVTGFPHTHMDRRPRKRPRLGWDVTQLPPQAQVGMFCAQEVGRVTGFASSTAKAPADYASTITTSSSVVLKGGVAQNGSPPWRDDDKDGHYMFELGDNLTSRYKIQSKMGEGTFGQVLECWDRERKEMVAIKIVRGIKKYREAAMIEIEMLQQLRKHDKGGNRCVQIRNWFDYRNHICIVFEKLGPSLYDFLRKNNYRSFPIDLVREIGRQLLECVAFMHDLNLIHTDLKPENILLVSPEYVKVPDYKGTLRSPKDSYFRRLPKSSAIKVIDFGSTTYERPDQNYIVSTRHYRAPEVILGLGWSYACDIWSVGCILVELCTGEALFQTHENLEHLAMMERVLGPLPQHMLKRVDRHAEKYVRRGRLDWPDGATSRESIKAVLKLPRLQNLIMQHVDHSAGDLIHLLQGLLRYDPIDRLTAREALRHPFFSRDQFRRLSLASIGWPGMNEYLRK

SEQ ID NO: 14173 - protein, 433 aa, Prunus mume
METERVTEFPFTHLDRRPRKRARLGWDVPQAAKAQVGMFCGQELGNVTSFASLMAPSDHTTISLFDKEVARNGSPPWREDDKDGHYMFSLGENLTSRYKIQSKMGEGTFGQVLECWDREKKEMVAVKIVRGVKKYREAAMIEIEVLQQLGKHDKGGNRCVQLRNWFDYRNHICIVFEKLGPSLYDFLKKNNYRSFPIDLVREIGRQLLECVAFMHDLRLIHTDLKPENILLVSHDYIKVPDYNKNSSRSPKDSSYFKRIPKSSAIKVIDFGSTTYERQDQNYIVSTRHYRAPEVILGMGWTYPCDVWSIGCILVELCTGEALFQTHENLEHLAMMERVLGPLPQHMLKRADRHAEKYVRRGRLDWPEGAASRESIRAVQKLPRLQNLVMQHVDHSAGDLIHLLQGLLRYDPSDRLSAREALRHSFFTKDNLRR

SEQ ID NO: 14174 - protein, 428 aa, Eutrema halophilum
MEMERVHEFPHTNMDRRPRKRARLGWDVLPLAPKAQVGMFCGQEIGNFSSFASSGAPSDISSTSLCVKTVARNDSPPWREDDKDGHYMFELGDDITPRYKIYSKMGEGTFGQVLECWDRERKEMVAVKIVRGVKKYREAAMIEIEMLQQLGKHDKGGNRCVQIRNWFDFRNHICIVFEKLGSSLYDFLRKNNYRSFPIDLVREIGWQLLECVAFMHDLRMIHTDLKPENILLVSSDYVKIPEYKGSRLQRDVSYKRVPKSSAIKVIDFGSTTYERQDQNYIVSTRHYRAPEVILGLGWSYPCDVWSIGCIIVELCTGEALFQTHENLEHLAMMERVLGPFPQQMLKKVDRHAEKYVRRGRLDWPDGATSRDSLKAVLKLPRLQNLIMQHVDHSAGELINMVQGLLRFDPAERLTAREALRHPFFTRRR

SEQ ID NO: 14175 - protein, 432 aa, Solanum phureja
METERVTGFPLTNLDRRPRKRARLGWDVLPEPPKAQLGLFCGQDVGNVTSYASSRQLTDLTSAPFTIKEVAQNGSPPRREDDKDGHFVFELGENLTSRYKIHSKMGEGTFGQVLECWDRERKEMVAIKIVRGMKKYRDAAMIEVEMLQQLGKHDNGNRCVQIWNWFDYRNHICIVFEKLGPSLYDFLRKNNYRSFPIDLVREIGRQLLDCVAFMHDLRLIHTDLKPENILLTSPEYVKVPDYKVSSRSPKDGSYYKRIPKSSAIKVIDFGSTTYDRQNQTYVVSTRHYRAPEVILGLGWSYPCDIWSVGCILVELCSGEALFQTHENLEHLAMMEKVLGPLPQHMLKRVDRQAEKYVRRGRLDWPEGATSRDSIKAVLKLARLQNIIMQHVDHSAGDLINLLQGLLRYDPSERLTAREALRHPFFTRDHLRR

SEQ ID NO: 14176 - protein, 457 aa, Gossypium hirsutum
MEMERVTGFPHTHMDRRPRKRPRLGWDVTQLPPLAQVGMFCAQEVGRVTGFASSTAKAPADYASTITTSSSVVLKGGVAQNGSPPWRDDDKDGHYMFELGDNLTSRYKIQSKMGEGTFGLVLECWDRERKEMVAIKIVRGVKKYREAAMIEIEMLQQLRKHDKGGNRCVQIRNWFDYRNHICIVFEKLGPSLYDFLRKNNYRSFPIDLVREIGRQLLECVAFMHDLNLIHTDLKPENILLVSPEYVKIPDYKGTLRSPKDSYFRRLPKSSAIKVIDFGSTTYERPDQNYIVSTRHYRAPEVILGLGWSYACDIWSVGCILVELCTGEALFQTHENLEHLAMMERVLGPLPQHMLKRVDRHAEKYVRRGRLDWPDGATSRDSIKAVLKLPRLQNLIMQHVDHSAGDLIHLLQGLLRYDPIDRLTAREALRHPFFSRDQFRRLSLAGIGWPGMNEYLRK

SEQ ID NO: 14177 - protein, 432 aa, Solanum lycopersicum
METERVTGFPLTNLDRRPRKRARLGWDVLPEPPKAQLGLFCGQDVGNVTSYASSRQLTDLTSAPFTIKGVAQNGSPPRREDDKDGHFVFELGENLTPRYKIHSKMGEGTFGQVLECWDRERKEMVAIKVVRGMKKYRDAAMIEVEMLQQLGKHDNGNRCVQIWNWFDYRNHICIVFEKLGPSLYDFLRKNNYRSFPIDLVREIGRQLLDCVAFMHDLRLIHTDLKPENILLISPEYVKVPDYKVSSRSPKDGSYYKRIPKSSAIKVIDFGSTTYDRQNQTYVVSTRHYRAPEVILGLGWTYPCDIWSVGCILVELCSGEALFQTHENLEHLAMMEKVLGPLPQHMLKRVDRQAEKYVRRGRLDWPEGATSRDSIRAVLKLARLQNIIMQHVDHSAGDLINLLQGLLRYDPSERLTAREALRHPFFTRDHLRR

SEQ ID NO: 14178 - protein, 125 aa, Ambrosia trifida
METERVTEFPMSQLDLRPRKRQRLGWDVAPLTPKAQVGLFCGQEIGNVTGFAPSGVISDYSSSSVLKRVARNVSPPWRQDDKDGHYVFAVGDNLTTRYKIHGKMGEGTFGQVLECWDKKKKRWLQ

SEQ ID NO: 14179 - protein, 412 aa, Euphorbia peplus
KRARLGWDVPLLPKAQVGNFCGQEVGNLQSYAGAISDHTTSNSLFVNGVARNGSPPWREDDKDGHYMFAIGDNLTSRYKIHSKMGEGTFGQVLECWDRERKEMVAIKIVRGVNKYREAAMIEIDVLQQLGKNDKGGNRCVQLRNWFDYRNHICIVFEKLGPSLYDFLRKNNYRSFPIDLVREIGRQLLECVAFMHDLRLIHTDLKPENILLVSADYVKVPDYKGSFRSPKESSYCKRVPKSSAIKVIDFGSTTYERQDQNYIVSTRHYRAPEVILGLGWSYPCDVWSIGCILVELCTGEALFQTHENLEHLAMMERVLGTLPQHMLKRVDRHAEKYVRRGRLDWPEGATSRESIRAVTKLQRLQNLIMQHVDHSAGDLIHLLQGLLKYDSSDRLTAREALRHPFFCRDNLRM

SEQ ID NO: 14180 - protein, 441 aa, Catharanthus roseus
MEMERVTEFPLTHLDRRPRKRPRLGWDVVPETPFQTQVAPKAQLGLFCGQELGNVTSYASSRATPEHSTSSLFNKGVARIGSPPWRGDDKDGHYLFELGENLTSRYKIHSKMGEGTFGQVLECWDRERKEMVAIKIVRGVKKYREAAMIEVDVLQQLGKHDKGGNRCVQIRNWFDYRNHICIVFEKLGPSLYDFLRKNNYRSFPIDLVREIGRQLLECVAFMHDLHLIHTDLKPENILLVSPEYIKVPDYRGFTRSPKDGSYYKRIPKSSAIKVIDFGSTTYDRQDQTYIVSTRHYRAPEVILGLGWSYPCDVWSVGCILVELCSGEALFQTHENLEHLAMMERVLGPLPQHMLKKADRNADKYVRRGRLDWPGAASRDSIKAVLKLPRLQNLVMQHVDHSGGDLIHLLQGLLKYEPLDRLTAREALRHPFFTRDCLRRSF

SEQ ID NO: 14181 - protein, 433 aa, Flaveria ramosissima
MEMERVTEFPISNVDIGPRKRQRIGWDVVHPAAKAQLGLFYGQDVGNVTSFAPSRAPQDHNNSSIVKHVAHNGSPPWREDDKDGHYMFALGDNLTSRYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYRSFPIDLVREIGRQLLECVAFMHDMCLIHTDLKPENILLVSPEYIKVPDYKGSSRSPKDSSYSKRIPKCSAIKVIDFGSTTYDRPDQNYIVSTRHYRAPEVILGLGWSYPCDIWSVGCILVELCSGEALFQTHENLEHLAMMERVLGFLPQHMLRKADRHADKYIRKGRLDWPEGATSRESIKAVQKLPRLQNLIMQHVDHSAGDLIHLLQGLLRYDPLDRLTAREALRHSFFTRDHFKRY

SEQ ID NO: 14182 - protein, 430 aa, Flaveria ramosissima
ERVTEFPMSQLDLRPRKRQRLGWDVAPAPTKAQVGLFCAQEIGNVTSFAPLGAPTDHISSSILKRVAREVSPPWRQDDKDGHYVFAVGDNLTTRYKIHGKMGEGTFGQVLECWDKERKEMVAIKIVRGIKKYREAAMIEIDVLQQLGKHDKGGNRCVQIRNWFDYRNHICIVFEKLGPSLYDFLRKNNYSSFPIDLVREIGRQLLECIAFMHDLRLIHTDLKPENVLLVSPEYVKVPDYKASSRSPRDCSFSKRVPKSSAIKVIDFGSTTYDRQDQNYIVSTRHYRAPEVILGLGWSYPCDIWSVGCILVELCTGEALFQTHENLEHLAMMEKILGTLPVHMLKKSDRHAEKYVRKGRLDWPEGATSRESIRAVMKLPRLQNLIMQHVDHSAGDLIHLLQGLLRYDPLDRLTARAALRHPFFTRDHFRRY

SEQ ID NO: 14183 - protein, 430 aa, Nicotiana benthamiana
METERVTEFPMTHLDLRPRKRARLGWDILPEQPKAQLELFCGQAVGNLTSYTTSRQPTDLTGTLVVKGRNGSPPWRNDDKDGHYTFELGENLSSRYKIHSKMGEGTFGQVLECWDREKKEMVAIKIVRGIKKYREAAMIEIEMLQQLGKHDKAGNCCVQIRNWFDYRNHICIVFEKLGPSLYDFLRKNNYRSFPIDLVREIGRQLLECVAFMHDLRLIHTDLKPENILLVSPDYIKVPDYKFSSRSPKDSSYYKRVPKSSAIKVIDFGSTIYDRQDQKYIVSTRHYRAPEVILGLGWRYACDVWSVGCILVELCSGEALFQTHENLEHLAMMERVLGSLPQHMLKRVDRQADKYVRRGRLDWPEGASSRDSIKAVLKLTRLQNIIMEHVDHSAGDLINLLHGLLRYDPSERLTAREALRHPFFTWGHLSR

SEQ ID NO: 14184 - protein, 432 aa, Solanum lycopersicum
METERVTGFPLTNLDRRPRKRARLGWDVLPEPPKAQLGLFCGQDVGNVTSYASSRQLTDLTSAPFTIKGVAQNGSPPRREDDKDGHFVFELGENLTPRYKIHSKMGEGTFGQVLECWDRERKEMVAIKIVRGMKKYRDAAMIEVEMLQQLGKHDNGNRCVQIWNWFDYRNHICIVFEKLGPSLYDFLRKNNYRSFPIDLVREIGRQLLDCVAFMHDLRLIHTDLKPENILLISPEYVKVPDYKVSSRSPKDGSYYKRIPKSSAIKVIDFGSTTYDRQNQTYVVSTRHYRAPEVILGLGWTYPCDIWSVGCILVELCSGEALFQTHENLEHLAMMEKVLGPLPQHMLKRVDRQAEKYVRRGRLDWPEGATSRDSIRAVLKLARLQNIIMQHVDHSAGDLINLLQGLLRYDPSERLTAREALRHPFFTRDHLRR

SEQ ID NO: 14185 - protein, 440 aa, Gossypium raimondii
MEMESVTEFPHTHMDRRPRKRPRLGWDVTQLPPQAQVGMFYSQEIWNVTSVASTAKAPSDCASTITTSSSVVLNGGVARNGSPPWREDDKDGHYMFELGDNLTSRYKIQSKMGEGTFGQVLECWDRERKEMVAIKIVRGIKKYHEAAMIEIEMLQQLGKHDKGGNRCVQIRNWFDYRNHICIVFEKLGPSLYDFLRNNNYRSFPIDLVRDIGRQLLECVAFMHDLRLIHTDLKPENILLVSPECVKVPDYKGTSRFPKGSSYFKRLPKSSAIKVIDFGSTTYERQDQTYIVSTRHYRAPEVILGLGWSYPCDIWSVGCILVELCTGEALFQTHENLEHLAMMERVLGPLHQHMLKRVDRHAEKYVRSGRLDWPDGAASRESMRAVLKLPRLQNLIMQHVDHSAGDLIHLLQGLLRYDPIDRLTAREALRHPFFSGDKFRR

SEQ ID NO: 14186 - protein, 428 aa, Euonymus alatus
MEMERVTGFPLDRRPRKRARLGWDVPLVPKAQVGIFCAQEVGNVISFASSRAPSDIIPNSLFVKGVDRNGSPPWREDDKDGHYVFAVGDNLTSRYKIHSKMGEGTFGQVLECWDQEREEMVAIKIVRGIKKYRDAAMIEIEVLQQLARQDKGNRCVQIRNWFDYRNHICIVCEKLGPSLYDFLRKNNYRSFPIDLVREIGRQLLECVAFMHELRLIHTDLKPENILLVSPDYVKVPDYKSSSRSPRDGSYFKRVPKYSSIKVIDFGSTTYERQDQSYVVSTRHYRAPEVILGLGWSYPCDVWSVGCILVEFCTGEALFQTHENLEHLAMMERVLGPLPHHILKKIDRHSEKYVRRGRLNWPEGATSRDSIRAVSKLPRLQNLIMQHVDHSAGDLIHLLQGLLRYDPTERLAAHNALKHPFFMREHQRR

SEQ ID NO: 14187 - protein, 440 aa, Gossypium raimondii
MEMESVTEFPHTHMDRRPRKRPRLGWDVTQLPPQAQVGMFYSQEIWNVTSVASTAKAPSDCASTITTSSSVVLNGGVARNGSPPWREDDKDGHYMFELGDNLTSRYKIQSKMGEGTFGQVLECWDRERKEMVAIKIVRGIKKYHEAAMIEIEMLQQLGKHDKGGNRCVQIRNWFDYRNHICIVFEKLGPSLYDFLRNNNYRSFPIDLVRDIGRQLLECVAFMHDLRLIHTDLKPENILLVSPECVKVPDYKGTSRFPKGSSYFKRLPKSSAIKVIDFGSTTYERQDQTYIVSTRHYRAPEVILGLGWSYPCDIWSVGCILVELCTGEALFQTHENLEHLAMMERVLGPLHQHMLKRVDRHAEKYVRSGRLDWPDGAASRDSMRAVLKLPRLQNLIMQHVDHSAGDLIHLLQGLLRYDPIDRLTAREALRHPFFSGDKFRR

SEQ ID NO: 14188 - protein, 431 aa, Triphysaria pusilla
MEMERVTELTMDRRPRKRARLGWDVLPQAPKAQLGLFTGQEIGNVTSYAPSSAISEHHSSLFVKKSLARNGSPPWREDDKDGHYVFEIGDYLTSRYKICSKMGEGTFGQVLECWDREKTEMVAIKIVRGIKKYRDAAMIEVEVLQQLARHDKGGTRCVQIRNWFDYRNHICIVCEKLGPSLYDFLRKNNYRSFPIDLVREIGRQLLECVAFMHDLHLIHTDLKPENILLVSPEYLKVPDYKGSSRSPKDGSYYKRVPKSSAIKVIDFGSTTYDKKDQSYIVSTRHYRAPEVILGLGWSYPCDVWSIGCILVELCSGEALFQTHENLEHLAMMERVIGPLPQHMLRKADRHADKYVSRGRLDWPEGATSRDSIKAVTKLPRLQNLIMNHVDHSAGDLIHLLQGLLRYDPNERMSAQEALKHSFFTRDRLSRY

SEQ ID NO: 14189 - protein, 427 aa, Cirsium arvense
MEMERVTEFPMSNVDLRPRKRQRLGWDAVHPATKAQLGLFCGQEVENVTSFAPSRAPQDHNNSSLVKRVARNGSPPWREDDKDGHYMFALGDNLTSRYKIHGKMGEGTFGQVLECWDKENNEMVAIKIVRGIKKYREAAMIEIDVLQQLRKHDKGGNRCVQIRNWFDYRNHICIVFEKLGPSLYDFLRKNNYRSFPIDLVREIGRQLLECIAFMHDLRLIHTDLKPENILLASPEYIRVPDYKGSSRSPKDSSYSKRVPKCSAIKVIDFGSTTYDRQDQSYIVSTRHYRAPEVILGLGWSYPCDIWSVGCILVELCSGEALFQTHENLEHLAMMERVLGFLPQHMLRKADRHAEKYIRKGRLDWPQGATSRESLKAVAKLPRLQNLIMQHVDHSAGELIQVLQGLMRYDPSERLTAREALRHPFFTR

SEQ ID NO: 14190 - protein, 430 aa, Triphysaria pusilla
METERVTELTMDRRPRKRARLGWDVLPQAHKAQLGLFSGQEIGNVTSYAPPSALLDHPNSLFVKNGLARNGSPPWRVDDKDGHYVFEIGDNLTSRYKICSKMGEGTFGQVLECWDREKTEMVAIKIVRGIKKYRDAAMIEVEVLQQLGRHDKGGNRCVQIRNWFDYRNHICIVCEKLGPSLYDFLRKNNYRSFPIDLVREIGRQLLECVAFIHELHLIHTDLKPENILLVSPEYLKVPDYKGSSRSPRDSLYYKRVPKSSAIKVIDFGSTTYDKDQSYIVSTRHYRAPEVILGLGWSYPCDIWSVGCILVELCSGEALFQTHENLEHLAMMERVLGPMPQQMLKKADRHAEKYVRRGRLDWPEGATSRDSMKAVTKLPRLQNLIMQHVDHSAGDLIHLLQGLLRYDPAERLSAQEALEHPFFTRDRLCRY

SEQ ID NO: 14191 - protein, 1134 aa, Malus domestica
MSSLSRELVFLILQFLDEEKFKETVHKLEQESGFFFNVKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPSLKNSRLRTLINQSLNWQHQLCKNPRPNPDIKTLFVDHSCGQPNGTRAPSPANNPLLGSLPKAGGFPPLGAHGPFQPTPAPVPIPLAGWMSNPSTVTHPAVSEGGGIGLGGPSITAALKHPRTPPTNPSVEYPSGDSDHVSKRTRPMGLSTEVNLPVNMLPVTFPGHGHGQPLNAPDDLPKNVTLTLNQGSSPMSMDFHPSQQTLLLVGTNVGDIGLWEVGSKERLVLRNFKVWDLSSCSMPLQAALVKDPGVSVNRVIWSPDGALFGVAYSRHIVQIYSYHGGDDVRQHLEIDAHVGGVNDIAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKDGESYIVEWNESEGAVKRTYQGFRKRSFGVVQFDTTKNRFLAAGDDFSIKFWDMDNIQLLTTVDADGGLPASPRIRFNKDGTLLAVSANENGIKVLANADGMRLLRTFENHLSYDASRPSEVVTKPAITPIQVAAAAASGAGLAERSASAAAVSGMNGDARNLGDVKPRIAEESNDKSKIWKLTEISEPSQCRSLRLPENMRVTKISRLIYTNSGSAILALASNAIHLLWKWQRSERNSSKATASVSPQLWQPSSGILMTNDITDTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNALVSSGADAQLCVWNSDGWEKLKSRFLQLPAGRTTASLSDTRVQFHHNQQQFLVVHETQLAIYETTKLECVKQWVPRDSAAPISHATFSCDSQLVYASFLDATVCVFSAANLRLRCRINPSAYLPANVSSNVQPLVIAAHPQEANQFALGLSDGAVHVFEPLESEGKWGVAPPVENGSASSAPATQVGTSGSDQAQR

SEQ ID NO: 14192 - protein, 1139 aa, Prunus mume
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPIPLAGWMSNPSTVTHPAASEGGAIGLGAPSITAALKHPRTPPTNPSVEYPSGDSDHVSKRTRPMGLSSEVNLPVNMLPVTFPGHGHGQALNAPDDLPKNVTRTLNQGSSPMSMDFHPLQQTLLLVGTNVGDIGLWEVGSRERLVLRNFKVWDLGSCSMPLQAALVKDPGVSVNRVIWSPDGSLFGVAYSRHIVQIYSYHGGDDIRQHQEIDAHVGGVNDLAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKEGESYIVEWNESEGAVKRTYQGFRKRSFGVVQFDTTKNRFLAAGDDFSIKFWDMDNTQLLTTVDADGGLPASPRIRFNKDGSLLAVSANENGIKVLANADGIRLLRTFENHLSYDASRTSEVVTKPAINPISVAAAAAAAAATSAGLADRSASAVSISGMNGDARNLGDVKPRIAEESNDKSKIWKLTEINEPSQCRSLRLPENMRVTKISRLIYTNSGSAILALASNAIHLLWKWQRSERNSTSKATASVSPQLWQPSSGILMTNDVADTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNPDGWEKQKSRFLQLPAGRTTASQSDTRVQFHQDQMHFLVVHETQLGIYETTKLECVKQWVPRDSAAPISHATFSCDSQLVYASFLDATVCVFSAANLRLRCRINPSVYLPANVSNNVQPLVIAAHPQEPNQFALGLSDGAVHVFEPLESEGKWGVPPPVENGSASSVPATQVGTAGSDQAQR

SEQ ID NO: 14193 - protein, 1146 aa, Prunus persica
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPIPLAGWMSNPSTVTHPAASEGGAIGLGAPSITGVSLHCAAALKHPRTPPTNPSVEYPSGDSDHVSKRTRPMGLSSEVNLPVNMLPVTFPGHGHGQALNAPDDLPKNVTRTLNQGSSPMSMDFHPLQQTLLLVGTNVGDIGLWEVGSRERLVLRNFKVWDLSSCSMPLQAALVKDPGVSVNRVIWSPDGSLFGVAYSRHIVQIYSYHGGDDIRQHKEIDAHVGGVNDLAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKDGESYIVEWNESEGAVKRTYQGFRKRSFGVVQFDTTKNRFLAAGDDFSIKFWDMDNIQLLTTVDADGGLPASPRIRFNKDGSLLAVSANENGIKVLANADGIRLLRTFENHLSYDASRTSEVVTKPAINPISVAAAAAAAAATSAGLADRSASAVSISGMNGDARNLGDVKPRIAEESNDKSKIWKLTEINEPSQCRSLRLPENMRVTKISRLIYTNSGSAILALASNAIHLLWKWQRSERNSASKATASVSPQLWQPSSGILMTNDIADTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKSRFLQLPAGRTTASQSDTRVQFHQDQMHFLVVHETQLAIYETTKLECVKQWVPRDSAAPISHATFSCDSQLVYASFLDATVCVFSAANLRLRCRINPSVYLPANVSNNVQPLVIAAHPQEPNQFALGLSDGAVHVFEPLESEGKWGVPPPVENGSASSVPATQVGTAGSDQAQR

SEQ ID NO: 14194 - protein, 512 aa, Glycine max
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGALPKAGGFPPLGAHGPFQPTPAPVPTPLAGWMSNPTTVAHAAVSGGGAIGLGAPSMPAALKHPRTPPTNPSVDYPSGDSDHVAKRTRPMGISDEVNLPVNVLSATFPGHGQHSQAFNAPDDIPKTVVRTLNQGSSPMSMDFHPIQQSLLLVGTNVGDIALWEVGSRERLVSRNFKVWDLSACSMPFQAALVKDPGVSVNRVIWSPDGALFGVAYSRHIVQIYSYHGGDEIRQHLEIDAHVGGVNDLAFSHPNKQLCVITCGDDKTIKVWDAASGAKQYTFEGHEAPVYSV

SEQ ID NO: 14195 - protein, 1142 aa, Theobroma cacao
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGGAIGLGASSIPAALKHPRTPPTNPSVDYPPGDSDHVSKRTRPMGISDEVNLPVNVLPVTFPGHGHSQTFNAPDDLPKTVARTLNQGSSPMSMDFHPKQQTLLLVGTNVGEIALWEVGSREQLVLKNFRVWELSACSMPLQAALAKDPAVSVNRVIWNQPHPEGSLFGVAYSRHIVQIYSYHGGDDVRQHLEIDAHVGGVNDLAFSLPNKQLCVITCGDDKTIKVWDASTGAKQFIFEGHEAPVYSVCPHHKENIQFIFSTAVDGKIKAWLYDNMGSRVDYEAPGRWCTTMAYSADGTRLFSCGTSKEGDSFIVEWNESEGAVKRTYQGFRKRSLGVVQFDTTKNRYLAAGDDFSIKFWDMDNISLLTSIDADGGLPASPRIRFNKDGSLLAVSTNDNGIKILANSDGMRLLRTMENLSYDASRASEAPKPTINSISAAAAAAAAVAATSAGIADRSASVVAIAAMNGDARSLGDVKPRITEESSDKSKIWKLTEISEPSQCRSLRLPENLRVTKISRLIFTNSGNAILALASNAIHLLWKWQRSERNTIGKATASVPPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSHVLNVLVSSGADSQLCVWNTDGWEKQKARFLQVSAGRTPMAQSDTRVQFHQDQIHFLVVHETQLAIYETTKLECVKQWVPRESSAPITHATFSCDSQLVYASFLDATVCVFSAANLRLRCRINPSAYLPASISSNVHPLVIAAHPSEPNEFALGLSDGGVHVFEPLESENKWGVPPPVENGSASSVAATPSVGAPGPEQAQR

SEQ ID NO: 14196 - protein, 1132 aa, Malus domestica
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPQIGAHGPFQPTQAPVPIPLAGWMSNPSTVTHPAVSEGGGIGLGGPSITAALKHPRTPPTNPSVEYPSGDSDHVSKRTRPMGLSTEVNLPVNMLPVTFQGHGHSQALNAPDDLPKNVTRTLNQGSSPMSMDFHPSQQTLLLVGTNVGDIGLWEVGSRERLVLRNFKVWDLSSCSMPLQAALVKEPGVSVNRVIWSPDGALFGVAYSRHIVQIYSYHGGDDVRQHLEIDAHVGGVNDLAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKDGESYIVEWNESEGAVKRTYQGFRKRSFGVVQFDTTKNRFLAAGDDFSIKFWDMDNTQLMTTVDADGGLPASPRIRFNKDGTLLAVSANENGIKVLANADGMRLLRTFENHLSYEASRTSEVVTKPAITPIQAAASSAGLAERSAAAAALSGMNGDARNLGDVKPRIAEESNDKSKIWKLTEISEPSQCRSLRLPENMRVTKISRLIYTNSGSAILALASNAIHLLWKWQRSERNSTSKATASVSPQLWQPTSGILMTNDITDTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWSSDGWEKLKSRFLQLPAGRTTASLSDTRVQFHHDQQQFLVVHETQLAIYETTKLECVKQWVPRDSAAPISHATFSCDSQLVYASFLDATVCVFSAANLRLRCRINPSAYLPANVSSNVQPLVIAAHPQEANQFALGLSDGAVHVFEPLESEGKWGVAPPVENGSASSAPANQVGAAGSDQVQR

SEQ ID NO: 14197 - protein, 1139 aa, Citrullus lanatus
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFSTFNEELFKEITQLLTLENFRENEQLSKYGDTKSARAIMLVELKKLIEANPLFRDKLQFPHLKNSRLRTLINQSLNWQHQLCKNPRPNPDIKTLFVDHSCGQPNGARAPSPANNPLLGSLPKPGGFPPLGAHGPFQPTAAPVPAPLAGWMSNPSAVTHPAVSGGGAIGLGAPSIPAALKHPRTPPTNPSVEYPSADSDHVSKRPKPMGMSDEVNLPVNVLPVSFAGHGHSQTFNAPDDLPKTVMRTLNQGSSPMSMDFHPVQQTLLLVGTNVGEIGLWEVGSRERLVSKSFKVWDLNACSMPLQAALLKEPDVSVNRVIWSPDGSLFGVAYSRHIVQIYSYHGGDDMRQHLEIDAHVGGVNDLAFSNPNKQLCVITCGDDKTIKVWDAGNGARQYTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFRKRSLGVVQFDTTKNRFLAAGDDFSIKFWDMDNVQLLTTVDADGGLPASPRIRFNKDGTLLAVSGNENGIKILANVDGIRLLRTFENLSYDAARTSEAGTKPTINPISAAAAVAAAAAASSAADRGASVVTMSGVAGDSRSLGDVKPRIPEDSNDKSKIWKLTEINEPSQCRSLRLPENVRVNKISRLIYTNSGSAILALASNAIHLLWKWTRSERNSTGKATANVLPQLWQPSSGILMTNDVADTSSEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHLLNVLVSSGADAQLCVWSSDGWEKQKTRFLQLPSGRPPSSQSDTRVQFHQDQVHFLVVHETQIAIYETTKLECVKQWTPRESGAPISHATFSCDSQMIYASFLDATVCVFTVASLRLRCRISPSAYLPASVSNASVQPLVIAAHPQEANQFALGLSDGGVHVFEPLESEGKWGVAPPVENGSASSVPTTPSVGASGSDQAPR

SEQ ID NO: 14198 - protein, 1134 aa, Echinacea purpurea
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFASFNEDLFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPTPLAGWMSNPPTVSHPTISGSAIGLGSPSISAALKHPRTPTNPSLDYPSADSDHMSKRARPMGITDEVNLPVNVLPVSFAGHSGHSQAFNAPDDLPKTVARTLNQGSSPMSMDFHPIQQTLLLVGTNVGDVGLWEVGSREKLVLKNFKVWNLSACSMPLQAALVKDPGVSVNRVIWSPDGSLFGVAYSRHIVQIYSYHGGDDVRQNVEIDAHVGGVNDLAFSNPNKQLCVITCGDDKTIKVWDATTGVKKYTFEGHEAPVYSVCPHYKENIQFIFSTALDGKIKAWLYDNMGSRVDYEAPGRYCTTMAYSADGTRLFSCGTSKDGESHIVEWNESEGAVKRTYLGFRKRSLGVVQFDTTKNRFLAAGDDFAIKYWDMDNTQLLMSVDADGGLPASPRIRFNKDGALLAVSTNDNGIKILANSDGLRLLRTFENLSFDGSASRTPEAAKPTINALSTPAASAALAERVASVGSISAVNGDARSLPDVKPRIMEEANDKSKIWKLSEINEASQCRSLKLPENMRVTKISRLIYTNSGNALLALASNAIHLLWKWQRNERNSSGKATAGVSPQLWQPSSGILMTNDVAETNPEESVACFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQICVWSSDGWEKQKAKYLQLPSGRTTAAQSDTRVQFHQDQIHFLVVHESQLAIYETTKLECVKQWVPRESSAPISHATFSCDSQLIYACFLDATVCVFTASHLRLRCRINPSVYLSPSVLSNLNVHPMVIAAHPQEPNQFALGLSDGMVHVFEPLESEGKWGVPPPAENASTSNVAATSPARGSGSEQGQR

SEQ ID NO: 14199 - protein, 1142 aa, Citrus clementina
MSSLSRELVFLILQFLDEEKFKETVHKLEQESGFFFNMKYFEDEVHNGNWDDVEKYLSGFTKVDDNRYSMKIFFEIRKQKYLEALDKHDRAKAVEILVKDLKVFSTFNEELFKEITQLLTLENFRENEQLSKYGDTKSARSIMLVELKKLIEANPLFRDKLQFPNLKNSRLRTLINQSLNWQHQLCKNPRPNPDIKTLFVDHTCGQPNGARAPSPANNPLLGSLPKAGVFPPLGAHGPFQPTPAPVPTPLAGWMSNPPTVTHPAVSGGAIGLGSPSIPAGTSLSHSALKHPRTPPTNPSVDYPSGDSDHLSKRTRPIGISDEINLPVNVLPVSFTGHSHSQAFSAPEDLPKTVTRTLNQGSSPMSMDFHPVQQTLLLVGTNVGDIGLWEVGSRERLVLRNFKVWDLGACSMPLQAALVKDPGVSVNRVIWSPDGSLFGVAYSRHIVQIYSYHGGDEVRQHLEIDAHVGGVNDIAFSHPNKQLCVITCGDDKTIKVWDATNGAKQYIFEGHEAPVYSVCPHHKENIQFIFSTALDGKIKAWLYDNLGSRVDYEAPGRWCTTMAYSADGTRLFSCGTSKDGESFIVEWNESEGAVKRTYQGFRKRSLGVVQFDTTKNRFLAAGDDFSIKFWDMDSVQLLTSIDADGGLPASPRIRFNKDGCLLAVSTNDNGIKILATSDGIRLLRTFENLAYDASRTSENSKPTISPISAAAAAAATSAGLADRAASMVSIPGMNGDVRSLADVKPRITEESNDKSKVWKLTELSEPNQCRSLRLPENLRATKISRLIFTNSGNAILALASNAIHLLWKWQRTERNSSGKATASVAPQLWQPPSGIMMTNDVTDSNPEEAVPCFALSKNDSYVMSASGGKISLFNMMTFKTMATFMPPPPAATFLAFHPQDNNIIAIGMDDSSIQIYNVRVDEVKSKLKGHSKRITGLAFSHALNVLVSSGADSQLCVWGSDGWEKQKNRFLQIPTGRTPTAQSDTRVQFHQDQIHFLVVHETQLAIFETTKLECVKQWVPRESSAPITHATFSCDSQLVYACFLDATVCVFSAANLKLRCRINPSAYLPAGVSSSNVHPLVIAAHPQEPNEFALGLSDGGVHVFEPLESEGKWGVPPPVDNGSTSSMPATPPVGGSGSDQAQR

SEQ ID NO: 14200 - protein, 1139 aa, Cucumis sativus
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFSTFNEELFKEITQLLTLENFRENEQLSKYGDTKSARAIMLVELKKLIEANPLFRDKLQFPHLKNSRLRTLINQSLNWQHQLCKNPRPNPDIKTLFVDHSCGQPNGARAPSPANNPLLGSLPKPGGFPPLGAHGPFQPTAAPVPAPLAGWMSNPSAVTHPAVSGGGAIGLGAPSIPAALKHPRTPPTNPSVEYPSADSDHVSKRPKPMGMSDEVNLPVNVLPVSFTGHGHAQNFNAPDDLPKTVMRTLNQGSNPMSMDFHPIQQTLLLVGTDVGEIGLWEVGSRERLVSKNFKVWDLNACSMPLQAALVKEPDVSVNRVIWSPDGSLFGVAYSRHIVQIYSYHGGDDMRQHLEIDAHVGGVNDLAFSNPNKQLCVITCGDDKTIKVWDAGNGARQYIFEGHEAPVFSVCPHYKENIQFIFSTALDGKIKAWLYDNMGSRVDYDAPGRWCTTMAYSADGTRLFSCGTSKDGDSYIVEWNESEGAVKRTYQGFRKRSLGVVQFDTTKNRFLAAGDDFSIKFWDMDNVQLLTTVDADGGLPASPRIRFNKDGTLLAVSGNENGIKILANVDGIRLLRTFENLSYDAARTSEAGTKPTINPISAAAAVAAAAAAGSAADRGASVVTMSGVAGDSRSLGDVKPRIPEDSNDKSKIWKLTEINEPSQCRSLRLPENVRVNKISRLIYTNSGSAILALASNAIHLLWKWTRSERNSTGKATANVLPQLWQPSSGILMTNDVADTSSEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHLLNVLVSSGADAQLCVWSSDVWEKQKTRFLQLPSGRPPSSQSDTRVQFHQDQVHFLVVHETQIAIYETTKLECVKQWTPRESGAPISHATFSCDSQMIYASFLDATVCVFTVASLRLRCRISPSAYLPASVSNASVQPLVIAAHPQEANQFALGLSDGGVHVFEPLESEGKWGVPPPVENGSASSVPTTPSVGASGSEQAPR

SEQ ID NO: 14201 - protein, 409 aa, Panax ginseng
MSSLSRELVFLILQFLDEEKFKETVHKLEQESGFYFNMKYFEEEVHNGNWDEVEKYLSGFTKVDDNRYSMKIFFEIRKQKYLEALDKNDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCAQPNGARAPSPASNPLLGSLPKAGVFPPLGAHGPFQPTAAPVPTPLAGWMSNPPAVGHPAVSGGAIGLGGPSMSAALKHPRTPSTNPSLDYPSGDSDHVTKRTRPMGISDEVNLPVNVLPLSFPGHGHSQAFNAPDDLPKNVARTLNQGSSPMSMDFHPIQQTLLLVGTNVGDIGLWEIGSREDWFLETSKFGILVHVQCLCRLL

SEQ ID NO: 14202 - protein, 1052 aa, Glycine max
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGALPKAGGFPPLGAHGPFQPTPAPVPTPLAGWMSNPTTVAHAAVSGGGAIGLGAPSMPAALKHPRTPPTNPSVDYPSGDSDHVAKRTRPMGISDEVNLPVNVLSATFPGHGQHSQAFNAPDDIPKTVVRTLNQGSSPMSMDFHPIQQSLLLVGTNVGDIALWEVGSRERLVSRNFKVWDLSACSMPFQAALVKDPGVSVNRVIWSPDGALFGVAYSRHIVQIYSYHGGDEIRQHLEIDAHVGGVNDLAFSHPNKQLCVITCGDDKTIKVWDAASGAKQYTFEGAVKRTYQGFRKRSLGVVQFDTTKNRFLAAGDDFSIKFWDMDNVQLLTTVDADGGLPASPRIRFNKDGTLLAVSANENGIKILANGDGIRLSRTLENSLYDASRASEALTKPIINPISAAAAAATSAALAERASSVVAIAGMNGDTRNLGDVKPRISEESNDKSKIWKLTEINEQSQCRSLKLPENVRVTKISRLIYTNSGNAILALASNAIHLLWKWQRNERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHNKRITGLAFSHVLNVLVSSGADAQICVWNTDGWEKQKSRFLQLPSGRTPPAQSDTRVQFHQDQIQFLVVHETQLAIYEATKLEGLKQWFPRDSSAPISYATFSCDSQLVYASFLDATICVFSASNLRLRCRINPSSYLPASVSSNTQPLVIAAHPQEPNQFAVGLSDGGVHVFEPLESEGKWGVPPPIENGSASNVAAASVGPSPDQAQR

SEQ ID NO: 14203 - protein, 1127 aa, Nicotiana benthamiana
MSSLSRELVFLILQFLDEEKFKESVHKLEQESGFFFNMKYFEDEVHNGNWDEVEKYLSGFTKVDDNRYSMKIFFEIRKQKYLEALDKRDRSKGVEILVKDLKVFASFNEDLFKEITQLLTLDNFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSVPKPGSFPPLGAHGPFQPGPPPVAAPLAGWMSNAPTVAHPAVSGGPMCLGSSSIPASLKHPRTPPTNPSIDYPSGESDHVAKRTRSLGISDEVNLPVNVLPISFPGQGHNQALSVPDDLPKTVARTLNQGSSPMSMDFHPSQQTLLLVGTNVGDIALWEVGSRERLVLRNFKVWDLGACSMPLQTALVKDPGVSVNRVIWSPDGSLFGVAYSRHIVQIYSYHGNDDIRQHLEIDAHVGGVNDLAFSHPNKQLCVITCGDDKTIKVWDATSGAKQYTFEGHEAPVYSVCPHHKENIQFIFSTALDGKIKAWLYDNLGSRVDYDAPGRWCTTMAYSADGTRLFSCGTSKDGESHIVEWNESEGAVKRTYLGFRKRSLGVVQFDTTKNRFLAAGDDFSIKFWDMDHVQLLTSIDADGGLPASPRIRFNKDGSLLAVSANENGIKILANSDGIRLVRTFENLAYDASRASESAKPTVNQISASSSGFADRVASGVGISGMNGDARNTVDVKPRIVEEPNDKSKIWKLTEITEPSQCRSLKLPENLRVTKISRLIYTNSGNAILALASNAIHLLWKWQRNERNSSGKATASVSPQLWQPSSGILMTNDVTEPNHEEAVSCFALSKNDSYVMSASGGKISLFNMMTFKTMTTFMPPPPAATFLAFHPQDNNIIAIGMDDSTIQIYNVRVDEVKSKLKGHSKRITGLAFSHSLNVLVSSGADSQLCVWSTDGWEKQRARSLQLLGRSTSQSDTRVQFHQDQTHFLVVHEAQIAIYETTKLECVKQWVPRESAAPISHATFSCDSQLIYASFLDATVCVFTFTPLHMRCRIIPSAYLSPSISNSNVHPVVVAAHPQDPNQFALGLSDGSVHVFEPLESEGKWGVPPPLENGSANGMPTAPSVGASGSEQAPR

SEQ ID NO: 14204 - protein, 1130 aa, Solanum lycopersicum
MSSLSRELVFLILQFLDEEKFKETVHKLEQESGFFFNMKYFEDEVHNGNWDEVEKYLSGFTKVDDNRYSMKIFFEIRKQKYLEALDKRDRSKGVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSVPKPGSFPPLGAHGPFQPGPAPVAAPLAGWMSNPPTVAHPAVSGGPMGLGPSSIPASLKHPRTPPTNPSIDYPSGESDHAAKRTRSLGISDEVNLPVNVLPISFPGQGHNQSLTVPDDLPKTVARTLNQGSSPMSMDFHPSQQTLLLVGTNVGDIALWEVGSRERLVLRNFKVWDLSACSMPLQTALVKDPGVSVNRVIWSPDGSLFGVAYSRHIVQIYSYHGNDDIRQHVEIDAHVGGVNDLAFSHPNKQLSVITCGDDKTIKVWDATSGARQYTFEGHEAPVYSVCPHHKETIQFIFSTALDGKIKAWLYDNLGSRVDYEAPGRWCTTMAYSADGTRLFSCGTSKDGESHIVEWNESEGAVKRTYQGFRKRSLGVVQFDTTKNRFLAAGDDFSIKFWDMDHVPLLTSIDADGGLPASPRIRFNKDGSLLAVSANENGIKILANNDGIRLIRTFENLAYDASRASETTKPTVNPISVASANNSGFADRVASVVGISGMNGDARNPVDVKPRINEEPNDKSKIWKLTEISESSQCRSLKLPENLRVTKISRLIYTNSGNAVLALASNAIHLLWKWQRNERNTSGKATASVSPQLWQPSSGILMTNDVHEPNHEEAVSCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADSQLCVWSTDGWEKQRARTLQLPGRSTSQSDTRVQFHQDQTHFLAVHEAQIAIFETTKLECLKQWVPRESAAPISHATFSCDSQLIYASFLDATVCVFTAGHLHMRCRIIPSAYLSPSISNSNIHPVVVAAHPQDPNQFALGLSDGSVHVFEPLESEGKWGVPPPLENGSTNGMPTAPSIGASGSDQAPR

SEQ ID NO: 14205 - protein, 1137 aa, Aquilegia formosa
MSSLSRELVFLILQFLDEEKFKETVHKLEQESGFFFNMKYFEDEVHNGNWDEVERYLSGFTKVDDNRYSMKIFFEIRKQKYLEALDKHDRAKAVEILVKDLKVFASFNEELFKEITQLLTLENFRENEQLSKYGDTKSARTIMLVELKKLIEANPLFRDKLQFPNLKNSRLRTLINQSLNWQHQLCKNPRPNPDIKTLFVDHTCGQPNGALAPSPANSSLLSMPKAGGFPPLGAHGPFQPAPAPVPTPLAGWMSNPATVPHPAVSGGAIGLGAPTNPAAMLKHPRTPPSNHVDYPSGDSDHVAKRTRPLGISDEVNLPVSISPVTYMGQSHNSAFSTDDLPKTVARTFSQGSSPMSMDFHPRQQTLLLVGTNVGDIALWEVGSRERLFLRNFKVWDLGACSMPLQASLVKDPSVAVNRIIWNPDGSLFGVAYSRHIVQIYAYHGGDDVRQHLEIDAHVGGVNDLAFSHPNKQLCVVTCGDDKTIKVWDAATGAKQYTFEGHEAPVYSVCPHYKENIQFIFSTALDGKIKAWLYDNLGSRVDYDAPGHWCTTMAYSADGSRLFSCGTSKDGESYIVEWNESEGAVKRTYLGFRKRSAGVVQFDTTKNRFLAAGDEFVIKIWDMDNVNLLTTMDAEGGLPASPRIRFNKEGTLLAVSANDNAIKVLATTDGLRLLRTFENRSFDASRAASEAVSKPSINPISAAAAAAAAAATSAGHADIGASVVSISGMNGDARNMGDVKPRITEEANDKSKIWKLTEISDGAQCRTMRLPDSIRSSKISRLIYTNTGTAILGLASNAVHFLWKWQRNERNSSGKATANVPPTLWQPSSGILMTNDIADVNPEECVPCFALSKNDSYVMSASGGKISLFNMMTFKTMTTFMPPPPAATFLAFHPQDNNIIAIGMDDSTIQIYNVRVDEVKSKLKGHSKRITGLAFSHALNVLVSSGADAQICVWNSDGWEKQKSRFLQIPAGRNPAALSDTRVQFHQDQIHFLVVHETQLAIYETTKLECLKQWVPRESSAPISHATLSCDSQLVYASFLDATVCIFGAANLRLRCRINPTAYLPANVSASIHPLVIAAHPQEPNQFALGLTDGGVHVFEPLESEGKWGVPPPVENGSGSGMPSAPAVGTSGSDQPQR

SEQ ID NO: 14206 - protein, 1120 aa, Citrus sinensis
MSSLSRELVFLILQFLDEEKFKETVHKLEQESGFFFNMKYFEDEVHNGNWDDVEKYLSGFTKVDDNRYSMKIFFEIRKQKYLEALDKHDRAKAVEILVKDLKVFSTFNEELFKEITQLLTLENFRENEQLSKYGDTKSARSIMLVELKKLIEANPLFRDKLQFPNLKNSRLRTLINQSLNWQHQLCKNPRPNPDIKTLFVDHTCGQPNGARAPSPANNPLLGSLPKAGVFPPLGAHGPFQPTPAPVPTPLAGWMSNPPTVTHPAVSGGAIGLGSPSIPAGTSLSHSALKHPRTPPTNPSVDYPSGDSDHLSKRTRPIGISDEINLPVNVLPVSFTGHSHSHSHSQAFSTPEDLPKTVTRTLNQGSSPMSMDFHPVQQTLLLVGTNVGDIGLWEVGSRERLVLRNFKVWDLGACSMPLQAALVKDPGVSVNRVIWSPDGSLFGVAYSRHIVQIYSYHGGDEVRQHLEIDAHVGGVNDIAFSHPNKQLCVITCGDDKTIKVWDATNGAKQYIFEGHEAPVYSVCPHHKENIQFIFSTALDGKIKAWLYDNLGSRVDYEAPGRWCTTMAYSADGTRTYQGFRKRSLGVVQFDTTKNRFLAAGDDFSIKFWDMDSVQLLTSIDADGGLPASPRIRFNKDGCLLAVSTNDNGIKILATSDGIRLLRTFENLAYDASRTSENSKPTISPISAAAAAAATSAGLADRAASMVSIPGMNGDVRSLADVKPRITEESNDKSKVWKLTELSEPNQCRSLRLPENLRATKISRLIFTNSGNAILALASNAIHLLWKWQRTERNSSGKATASVAPQLWQPPSGIMMTNDVTDSNPEEAVPCFALSKNDSYVMSASGGKISLFNMMTFKTMATFMPPPPAATFLAFHPQDNNIIAIGMDDSSIQIYNVRVDEVKSKLKGHSKRITGLAFSHALNVLVSSGADSQLCVWSSDGWEKQKNRFLQIPTGRTPTAQSDTRVQFHQDQIHFLVVHETQLAIFETTKLECVKQWVPRESSAPITHATFSCDSQLVYACFLDATVCVFSAANLKLRCRINPSAYLPAGVSSSNVHPLVIAAHPQEPNEFALGLSDGGVHVFEPLESEGKWGVPPPVDNGSTSSMPATPPVGGSGSDQAQR

SEQ ID NO: 14207 - protein, 280 aa, Flaveria ramosissima
MSSLSRELVFLILQFLDEEKFKEAVHKLEQESGFFFNMKYFEEEVHNGNWDEVEKYLSGFTKVDDNRYSMKIFFEIRKQKYLEALDKNDRSKAVEILVKDLKVFSSFNEDLFKEITQLLTLDNFRENEQLSKYGDTKSARTIMLVELKKLIEANPLFRDKLQFPSLKNSRLRTLINQSLNWQHQLCKILGQIQISKRYLSTIRVVNQMVHALHHLLVIRFLDHYLKLVAFLLWVHMGRFNLHRLQYQLRLLVGCLIRHLYLIQRFLVVQLVSVVHLFQLL

SEQ ID NO: 14208 - protein, 1133 aa, Oryza sativa
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKSSRLRTLINQSLNWQHQLCKNPRPNPDIKTLFVDHSCGQPNGARAPSPANNPLLGSIPKPGGFPPLGAHAPFQPAPTPVPPLAGWMSNPPAVTHPAVSGGAIGFGTPTNPAAILKHPRTPTTANPSMDYPSGDSDHVSKRTRPVGMSEEVNLPVNMLPVTYPQSHSYPQDDFHKNVARTLSQGSTPMSMDFHPVQQTLLLVGTNVGDIGLWDVGTKERLVLRNFKVWDLTKCSMALQASLVKDPTVSVNRIIWSPDGTLFGVAYSRHIVQIYSYHGGDDIRQHLEIDAHVGGVNDIAFAHPNKQLCIITCGDDKTIKVWEATSGAKQFTFEGHEAPVYSVCPHYKENIQFIFSTALDGKIKAWLYDNLGSRVDYDAPGHWCTTMAYSADGSRLFSCGTSKDGESHLVEWNESEGAVKRTYQGFRKRSMGVVQFDTTRNRFLAAGDEFLIKIWDMDNTSLLTTIDADGGLPASPRVRFNKEGTLLAVSTHENGIKILANADGVRLLRTLENRSFDASRSASETVTKPLMNPLTAAAAAAASAAAAGTSSGNAAPPAITALNGDSRSLVDVKPRIADEPLDKSKVWKLMEITESSQCRSLKLTDNMRTSKISRLIYTNSGVAILALASNAVHLLWKWPRNDRNSSGKATASVSPQLWQPPSGILMTNDITDNPEEAVHCFALSKNDSYVMSASGGKISLFNMMTFKTMTTFMPPPPAATFLAFHPQDNNIIAIGMDDSTIQIYNVRIDEVKSKLRGHSKKITGLAFSNVLNVLVSSGADAQICVWSTDGWDKLKSRMLQIPSSRPSSIILDTRVQFHQDQLHFLVVHETQIAIYETTKLEPVKQWPVRENSSPITHAMFSCDSQLIYASFLDATVCIFNASSLRLQCRILPASYLPQNISSNVYPVVVAAHPSEANQFALGLTDGGVYVLEPLESERKWGNPPPAENGSTSALSTPPNGASSSDQPER

SEQ ID NO: 14209 - protein, 139 aa, Trigonella foenum-graecum
MASSSMASAATGFVLSLNVAANNTASSRSTMLMFPLKSNNIGSSSRLVVRAADEAAPATAPPAGEAAAAPKPKPPPIGPKRGAKVKILRKESYWYKGTGSVVAVDQDPKTRYPVVVRFNKVNYANVSTNNYALDEIEEV

SEQ ID NO: 14210 - protein, 147 aa, Trifolium pratense
MATSSMASAACGFMLSLNVAATTTSSSATSSRSAMLMFPIKSNNIGSSSSRLVVRASEEPAAGAPATAAAPPAGDAAPKPKPPPIGPKRGAKVKILRKESYWYKGTGSVVAVDQDPKTRYPVVVRFNKVNYANVSTNNYALDEIEEV

SEQ ID NO: 14211 - protein, 141 aa, Cicer arietinum
MASSSMASAATGFVLSLNVVASNTNSSALSRSTMLMFPIKSNTIATSRLVVRASDDAAPATATPPADAEVAAKPKPPPIGPKRGAKVKILRKESYWYKGTGSVVAVDQDPKTRYPVVVRFNKVNYANVSTNNYALDEIEEV

SEQ ID NO: 14212 - protein, 393 aa, Cicer arietinum
MAIFSTTLGSFASISFLSHSQPDSFSSSTVNPFTFPKFPHKFAPSQCHHHHRHKIFVSGSSNSSSDTHIDEFASGLLQRPSAPDSYEALRQARRSSDWKAANAYRDSGLIYNGRVEGSNAGGLLLRFYSIMGFLPYPQLSPLHACKAPEKTIQEIARDLLGSILPVKVIIVDEDKRKLVLSEKEASWFKHSKHVNIGDIFEAIVGSVEDYGAFVHLRFPNGLYHLTGLIHISEVSWDLVQDVRDFLTEGDKVRVKVISIDSVKSRITLSIKQLEEDPLLETLDKVIPQDGSAALDIFSGSNSSGIEPLPGLETILEELLQEYGIYEARISRQGFEKRVVSQDLQLWLSNAPPMDQRFTLLARAGRQVQEIHLKTSLDQEGIKKAIQRVLERVP

SEQ ID NO: 14213 - protein, 185 aa, Trigonella foenum-graecum
IASSLKRRLHSTTTTTTTIVNPFNFPKCPHKLPPCQWHPHYRHHNTSKIFVSGSNNNHIDELDSGLLQRPYAPHSQDALRQARRSSDWKAANAYRDSGLIYNGRVEAFNAGGLLLRFYSLMGFLPYPHFSPVHACQEPDKTIQEIARELIGSILSVKVIAVDEEERKLVLSERKLHGLNIQNMST

SEQ ID NO: 14214 - protein, 353 aa, Trigonella foenum-graecum
HPLPQTKTPNYNPMFFYQQQQQQHNRHRHGKTQQGTYEQKQNKVCVLWDLDNKPPRGPPYNAALSLKTLAERFGDVTDISAYANRHAFIHLPQWVLNQRRERKNLDILERKGIINPSEPYICSVCGRKCKTNVDLKKHFKQLHQRERQKKVNRLNSLKGKKRQKYKERFVSGDEKYNNAVREILKPKVGYGLASELRRAGVFVKTVEDKPQAADWALKKQMMHSMSRGIDWLFLVSDDSDFSEMLRKAREANLGTVVVGDVDKALGRHADLWVPWNAVENGEVLDMDLVPKNRDRRRTSATTTTTTMDDFGDVLFYHEGEEMVMEEDFMLEYSDDEDFDEDSDEEDEDGFFIY

SEQ ID NO: 14215 - protein, 328 aa, Cicer arietinum
MVKTKQGTYEPKQNKVVVLWDLDNKPPRGPPYEAALSLKTLAERFGQLTDFSAYANRHAFIHLPQWVLNQRRERKNLDILERKGIINPSELYVCTVCGRKCKTNLDLKKHFKQLHQRERQKKLNRLNSLKGKKRQKYKERFVSGDHKYNDAVRRIVTPKVGYGLASELRRAGVFVKTVEDKPQAADWALKKQIMHSMTRGIDWLFLVSDDSDFSDMLRRAREANLGTVVVGDVDRVLGRDADLWVPWTAVENGEVMDMDLVPKSRGRRRNSTGTTTTTTMNDFGDVLFFHGGEEMEEDFMLEYSEDEDFDDDEYTSDEEEEDDGFYIY

SEQ ID NO: 14216 - protein, 369 aa, Cicer arietinum
MFGVNRISHHFRDCEHFGGFVGFRFNFNSLHTFHLSFPCSLKPSFAPSTTTLRSNNCFSSTPSNSPRQIPLLFHCFSQQEDEREILSDGISAVAGGVVALGKFDALHIGHRELAIQASRAGPPFLLSFVGMAKVLGWENRAPIVAKCDRKRILSSWVPYCGNMVPEEFQIEFSCVRHLSPQQFVEKLSKELKVRGVVAGENYRFGYKAAGDALELVKLCEEYGMEAYIIKSVMDKNQFSTNINSSASSKERGQVSSTRVREALAVGDMTYVSELLGRQHRLVLMATDRERFSFGQYKVSAPKSCLLNLAPKEGLYEKCSLLLGQENVMLCRVIIDSKFVHIEPDFGGSSDIFGTHNLQYLHIEFGDSNP

SEQ ID NO: 14217 - protein, 340 aa, Panicum virgatum
MAATAAALVRALSSPPSPSPPLSSRPRPRALRGDTLLSLREKPRARVVCAAAASGSSNFGNQTSLMPPFSFTLDEGFSRSKKPYRWQRVLLKVSGEALAGDHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRHNPNARLLETVSYHEVTTRDLSVMDMTAITLCQENNIPVVVFNLQKPGNIAKAIVGEKVGTFIGCTGNQEQNGNALHEERRLVNEA

SEQ ID NO: 14218 - protein, 338 aa, Setaria italica
MAASAAVVQALSSPPSLSPLLPSRPRALRINIPLSLSAKPRARATAAAAAGSDSSNFGNQTSLLPPFSFTLDEGSSRSKRPYRWQRVLLKVSGEALAGDRTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRHNPNAHLLETVSYHEVTTRDLSVMDMTAITLCQENNIPVVVFNLQKPGNIAKAIVGEKVGTFIGCTRNQEQNGNAMGEERRLVNEV

SEQ ID NO: 14219 - protein, 337 aa, Pennisetum glaucum
AASAAAVPALSSPPSLSPLLPSRPRALRINTPLSLSAKPRAWAATAAAAGSDSSNFGNQASLMPPFSFTLDEGSSRSKRPYRWQRVLLKVSGEALAGDRTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRYNPNTRLLETVSYHEVITRDLSVMDMTAITLCQENNIPVVVFNLQKPGNIAKAIVGENVGTFIGCTRDQEKNGNALGEERRLVNEV

SEQ ID NO: 14220 - protein, 342 aa, Zea mays
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYHEVTTRDLSVMDMTAITLCQENNIPIVVFNLQEPGNIAKAIVGEKVGTFIGCTRDQELNGNTLVQERRLVNEA

SEQ ID NO: 14221 - protein, 269 aa, Glycine max
MASCSIGTPNIKALNLHFGGKKVGLSQQFGTRSWISKQSLQYTSLVMSRQKVRFSPTEIQFVTRSEGSEEVKSSGLTSELIPNLIEVEFLLTKLCDTSSIGELDLKLAGFHLHVVRDLTEKTKTLPPPIPASESIINVTETPKTNGSVSTTSLAVSKPVDPIPSSGSIQRFLNKAADEGLVIIQSPKVGFFRRSRTIKGRRAPPSCKEKQNVEEGQVICYIEQLGGELPIESDVSGEVIKILQKDGDPVGYGDALVAILPSFPGIKKLQ

SEQ ID NO: 14222 - protein, 273 aa, Cajanus cajan
MASCSLGTSNIKLLNLHFGGIKFGLSQQYGTRSWISRQSLQYTSLVMSRQTVRFLASPNDPSPDIEFVTKSEEDSEENKSSGLTSELIPNFNEVEFLLTKLCDTSSIGELDLKLAGFHLHVVRDLGENIKTLPSASPASVSINNVPETPKTNGSVSTTSLAISNPVPSLGSIQRFLDKAADEGLVIIQSPKVGFFRRSRTIKGKRAPPSCKEKQNVEEGQVICYIEQLGGELPIESDVTGEVIKILRKDGDPVGYGDALVAILPSFPGIKKLQ

SEQ ID NO: 14223 - protein, 861 aa, Glycine max
MANEELGSWTDLLHSSTKLLEQAAPSAQFPPLQRNLDQLEALSKKLKSKTVRTEAPSQSIAATRLLAREGINAEQLARDLKSFELKTTFEDVFPVEATSVEEYLQQVHEMAMVSAVQEAQKDNLRSFNDYMMKVLEEDWQKEKRDFLQSLSRISTLPRTNIAANSNVGTLPGQIVSVSSTSQVSSGMPSMEIVSLTGRPIVEKKASVYAEVVKKLNKAREAGSPFKPAAAFKGAYENLGIDASGGKSVTMRKIWHLVQMLMGEDSAVQCVSKRMSLIIGARRHLEWGHEKYIMDTIQSHPAQAALGGGVGNLQRIRAFLRIRLRDYGVLDFDAGDARRQPPVDTTWQQIYFCLRSGYYDEARNVAQSSRTSHQFAPLLTEWINKGGMVPEEIATAASEECERMLRTGDRVGRTAYDKKKLLLYAIISGSRRHIDRLLRDQPSLFSTIEDFLWFKLSAVRDCPSGPSSIVLSDGLIPYSLDDLQSYLNKFEPSYYTKNGKDPLVYPYILLLSIQLLPAVLYLSKEAGDEGYNIDAAHLSIVLADHGVLSEGAGSGQKLGVMDAYAEVSTIIRQYGSMYLRLGDLQMALEYFAQAAAAVGGGELSWTGRGNVDQQRQRNLMVKQLLTELLLRDGGIYLLLGARGTGEEGELGRFVTDPKARQQFLIEAACQCQEAGMYDKSIEIQKRVGSFSTALDTINKCLSEAICALFRGRLDGESRTAGLIHSGNEILETYSYYPDVRLQEREHVFDQQTVLRQLESILSIHKLARLGHYLDALREVAKLPFLPLDPRGPDIAVDVLENLSPHVQACIPDLLKTALTCLDNVTDSDGSLRALRAKIASFIANNLRRNWPRDLYERVAQRL

SEQ ID NO: 14224 - protein, 858 aa, Cajanus cajan
MANESWTDLLHSSTKLLEQAAPSAQFPPLQRNLDQLEALSKKLKSKTVRTEAPSQSIAATRLLAREGINAEQLARDLKSFELKTAFEDVFPVEATSVEEYLQQVHEMAMVSAVQEAQKDNLRSFSDYMMKVLEEDWQKEKRDFLQSLSRISTLPRTNIAANSSVGTLPGQIASVSSTPQVSSGMPSMEIVPLTGRPIVEKKASVYAEVVKTLNRARESGLPFKPAAAFKGAYENLGIDASGGKSVTMRKIWHLVQMLMGEDSTPQRVSKRMSLVIGARRHLEWGHEKHIMDTIQSHPAQAALGGGVGNLQRIHAFLRIRLRDYGVLDFDAGDARRQPPVDTTWQQIYFCLRSGYYDEARNVALSSRASHQFSPLLTEWINTGGMVPEEVAAAASEECERMLRTGDRVGRTAYDKKKLLLYAIISGSRRHIDRLLRDQPNLFSTIEDFLWFKLSAVRDCSSGPSSIVLSDGLIPYSLDDLQIYLNKFEPSYYTKNGKDPLVYPYILLLSIQLLPAILYLSKEAGDEGYNIDAAHLSIVLADHGVLSEGAGSGQKLGVMDAYAEVSTIIRQYGSMYLRLGDLQMALEYYAQAAAAVGGGQLSWTGRGNVDQQRQRNLMLKQLLTELLLRDGGIYLLLGARGAGEEGELGRFVTDPNARQQFLIEAACQCQEAGMYDKSIEIQKRVGSFSMALDTINRCLSEAICSLFRGRLDGESQTAGLIHSGNEILETYTYYPDVSLQERDHVFEQQTVLRQLESILSIHKLARVGHYVDALREVAKLPFLPLDPRGPDIAGDVFENLSPHVQACIPDLLKAALTCLDNVTDSDGSLRALRAKIASFIANNLKRNWPRDLYERVAQRL

SEQ ID NO: 14225 - protein, 861 aa, Phaseolus vulgaris
MANEDFSSWTDLLHSSTKLLEQAAPSAQFPPLQRNLDQLESLSKKLKSKTVRTEAPSQSIAATRLLAREGINAEQLARDLKSFELKTTFEDVFPVEATSVEEYLQQVHEMAMVSAVQEAQKDNLRSFNDYMMKVLEEDWQKEKRDFLQSLSRISTLPRTNIAANSSVGTLPGQIASVSSTPQVSSGSSSMEIVPLSGRPIVEKKASVYAEVVKNLNKARESGLPFKPAAAFKGAYENLGIDASGGKSVTMRKIWHLVQMLMGEDSAPQRVSKRMSLIIGARRHLEWGHEKYIMDTIQSHPAQAALGGGVGNLHRIRAFLRIRLRDYGVLDFDAGDARRQPPVDTTWQQIYFCLRSGYYDDARNIALSSRASHQFAPLLTEWINTGGMVPEEIAAAASEECERMLRTGDRVGRTAYDKKKLLLYAIISGSRRHIDRLLRDQPTLFSTIEDFLWFKLSAVRDCPSGPSSIVLSDSLIPYSLDDLQSYLNKFEPSYYTKNGKDPLVYPYILLLSIQLLPAVLYLSKEAGDEGYNIDAVHLSIVLADHGVLSEGAGSGQKLGVMDAYAEVSTIIRQYGSMYLRIGDLQMALEFYAQAAAAVGGGQLSWTGRGNVDQQRQRNLMLKQLLTELLLRDGGIYLLLGARGSGEEGELGRFVTDPKAREQFLIEAALQCQEAGMYDKSIEIQKRVGSFSMALDTINKCLSEAIIALFRGRLDGESRTAGFIHSGNEILETYAYYPDVSHQEREHVFQQQTVLRQLESILSIHKLARLGHYVDALREVAKLPFLPLDPRGSDSAVDAFENLSSHVQACVPDLLKVALSCLDNLTDSDGSLRALRAKIASFIANNLKRNWPRDLYERVAQRL

SEQ ID NO: 14226 - protein, 859 aa, Medicago truncatula
MANEDLSSWTDLLHSSSKLLEQAAPSAQFPPLQRNLDQLEALSKKLKSKTVRAEAPSQSIAATRLLAREGINAEQLARDLKSFELKTTFEDVFPVEATSVEEYLQQVHEMAMVSAVQEAQKDNLRSFNDYMMKVLEEDWQKEKRDFLQSLSRISTLPRTNMIANSNVGTRPGQIVSMASTPQVSSGSMEIVPMTSRPIADKKASVYAEVVKNLNRARQSGLPFKLAATFKGAYESLGVDAGGGKSVTMRKIWHLVQMLMDEDSTLRRVSKRMSLIIGARRHLEWGHEKYIMDTIHNHPAQASLGGGVGNLQRIRAFLRIRLRDYGVLDFDAGDARRQPPVDTTWQQIYFCLRSGYYDEARNVALSSRASHQFAPLLTEWINTGGMVPEEVATAASEECERMLRTGDRVGRTAYDKKKLLLYAIISGSRRHIDRLLRDQPTLFSTIEDFLWFKLSAVRDCPSGSSSIVLSDGLIPYSLDDLQSYLNKFEPSYYTKNGKDPLVYPYILLLSIQLLPAVLYLSKEAGDEGYNIDAAHLSIVLADHGVLSEGIGTGQKLGVMDAYAEVSTIIRQYGSMYLRLGDLQMALEYYAQAAAAVGGGQLSWTGRGNVDQQRQRNLMLKQLLTELLLRDGGIYLLLGARGAGEEGELGRFVADPNARQQFLIEAACQCQESGMYDKSIEIQKRVGSFSMALDTINKCLSEAICSLFRGRLDGESRTAGLIHSGNEILETYTYYPDVSHQEREQVFEQQTILRQLESILSIHKLSRLGNHVDALREVAKLPFLPLDPRGPDTAVDVFENLSPHVQACIPDLLKVALTCLDNVTDSDGSLRALRAKISSFIANNVKRNWPRDLYERVAQRL

SEQ ID NO: 14227 - protein, 859 aa, Trigonella foenum-graecum
MANEDLSSWTDLLHSSSKLLEQAAPSAQFPPLQRNLDQLEALSKKLKSKTVRAEAPSQSIAATRLLAREGINAEQLARDLKSFELKTTFEDVFPVEATSVEEYLQQVHEMAMVSAIQEAQKDNLRSFNDYMMKVLEEDWQKEKRDFLQSLSRISTLPRTNMIANSNVGTRPGQIVSMASTPHVSSGSMEIVPMTSRPIADKKASVYAEVVKNLNRARQSGLPFKLAAAFKGAYESLGIDAGGGKSVTMRKIWHLVQMLMDEDSTLRRVSKRMSLIIGARRHLEWGHEKHIMDTIHNHPAQASLGGGVGNLQRIRAFLRIRLRDYGVLDFDAGDARRQPPVDTTWQQIYFCLRSGYYDEARNVALSSRASHQFAPLLTEWINTGGMVPEEVATAASEECERMLRTGDRVGRTAYDKKKLLLYAIISGSRRHIDRLLRDQPTLFSTIEDFLWFKLSAVRDCPSGSSSIVLSDGLIPYSLDDLQSYLNKFEPSYYTKNGKDPLVYPYILLLSIQLLPAVLYLSKETGDEGYNIDAAHLSIVLADQGVLSEGIGTGQKLGVMDAYAEVSTIIRQYGSMYLRLGDLQMALEYYAQAAAAVGGGQLSWTGRSNVDQQRQRNLMLKQLLTELLLRDGGIYLLLGARGAGEEGELGRFVADPNARQQFLIEAACQCQEAGMYDKSIEIQKRVGSFSMALDTINKCLSEAICSLFRGRLDGESRTAGLIHSGNEILEAYTYYPDVSLQERDHVFEQQTVLRQLESILSIHKLSRLGNHVDALREVAKLPFLPLDPRGPDIAVDVFENLSPHVQACIPDLLKVALTCLDNVTDSDGSLRALRAKIASFIANNVKRNWPRDLYERVAQRL

SEQ ID NO: 14228 - protein, 859 aa, Cicer arietinum
MANEDLASWTDLLHSSSKLLEQAAPSAQFPPLQRNLDQLEALSKKLKSKTVRAEAPSQSIAATRLLAREGINAEQLARDLKSFELKTTFEDVFPVEATSVEEYLQQVHEMAMISAVQEAQKDNHRSFNDYMMKVLEEDWQKEKRDFLQSLSRISTLPRTNMIANSNVGTRPGQIVSMASSPQVSSGSMEIVPTTSRPIVEKKASVYAEVVKNLNRARQSGLPFKPATGFKGAYESLGIDSSGGKSVTMRKIWHLVQMLMNEDSTLRRVSKRMSLIIGARRHLEWGHEKYIMDTIHNHPAQASLGGGVGNLQRIRAFLRIRLRDYGVLDFDAGDARRQPPVDTTWQQIYFCLRSGYYDEARNVSLSSRASHQFAPLLTEWINTGGMVPEEVATAASEECERMLRTGDRVGRTAYDKKKLLLYAIISGSRRHIDRLLRDQPTLFSTIEDFLWFKLSAVRDCPTGSSSIVLSDGLIPYSLDDLQSYLNKFEPSYYTKNGKDPLVYPYVLLLSIQLLPAVLYLSKETGDEGYNIDAAHLSILLADHGVLSEGAGTGQKLGVMDAYAEVSTIIRQYGSMYLRLGDLQMALEYYAQAAAAIGGGQLSWTGRGNVDQQRQRNLMLKQLLTELLLRDGGIYLLLGARGAGEEGELGRFVADPNARQQFLIEAACQCQEAGMYDKSIEIQKRVGSFSMALDTINKCLSEAICSLFRGRLDGESRTAGLIHSGNEILETYTYYPDVSLQEREHVFEQQTVLRQLESILSIHKLSRLGNHVDALREVAKLPFLPLDPRGPDIVVDVFENLSPHVQACIPDLLKVALTCLDNVTDSDGSLRALRAKIANFIANNVKRNWPRDLYERVAQRL

SEQ ID NO: 14229 - protein, 855 aa, Lotus japonicus
MANEDLASWSDLLHSSTKLLEQAAPSAQFPPLQRNLDQLEALSKKLKSKTVRAEAPSQSIAATRLLAREGINAEQLARDLKSFELKTTFEDVFPVEATSVEEYLQQVHEMAMVSAVQEAQKDNLRSFNDYMMKVLEEDWHKEKRDFLQSLNRISTLPRTNMVTNSNGGTRQGQIVSVASNVPSMEVVPFTTRPIAEKKASVYAEVVKNLNRARQSGLPFKPAAAFKGAYESLNIDASGGKSVTMRKIWHLVQMLMDTDSPLQHVSKKMSLIIGARRHLEWGHEKYIMDTIQSHPAQAALGGGVGNLQRIRAFLRIRLRDYGALDFDAGDARRQPPVDTTWQQIYFCLRSGYYDEARNVALSSRASHQFAPLLTEWINTGGMVAEEIAVAASEECERMLRTGDRVGRAGYDKKKLLLFAIISGSRRHIDRLLRDQPTLFSTIEDFLWFKLSAVRDCPGGSSSIVLSDGLIPYSLDDLQIYLNKFEPSYYTKNGKDPLVYPYILLLSIQLLPAVLHLSKETGDEGYNIDAAHLSIVLADHGVLSEGAGAGQKLGVMDAYAEVSTIIRQYGSMYLRLGDLQMALEYYAQAAAAVGGGQLSWTGRGNVDQQRQRNLMLKQLLTELLLRDGGIYLLLGARGAGEEGELGRFVTDFKARKQFLYEAACQCQEAGMYDKSIEIQKRVGSFSMALDTINKCLSEAICALFRGRLDGESQTAGLIHSGNEILEAYPYYPDVSPQERIDVFEQQAVLRELESILSIHKLSRLGHHVDALREVAKLPFLPLDPRGPDVAIDVFENLSPHVQACIPDLLKVALTCLDYVTDSDGSLRALRAKIASFIANNLKRNWPRDLYERVAQRL

SEQ ID NO: 14230 - protein, 858 aa, Arachis hypogaea
MANEDLSSWSDLLHSSSKLLEQAAPSAQFPPLQRNLDQLEALSKKLKSKTLRTEAPSQSIAATRLLAREGINAEQLARDLKSFELKTTFEDVFPVEATSVEEYLQQVHEMAMVSAVQEAQKDNLRSFNDYMMKVLEEDWQKEKRDFLQSLSRISTLPRTNMLAASNVGTHSGQVVSMASGPQVSSGVSSMDIVPPSSRPIMEKKASLYAEVVKNLNKARESGLPFKPAAAFRAAYESLGIEASGGKSVTMRKIWHLVQMLLGEDSTVQNVSKRMALIIGARRHLEWGHEKYVMDTIQSHPAQAALGGGVGNLQRIRAFLRIRLRDYGILDFDAGDARRQPPVDTTWQQIYFCLRTGYYDEARNVALSSRASHQFAPLLTEWINTGGMVPEEIAVAAMEECERMLRTGDRVGRAAYDKKKLLLYAIISGSRRHIDRMLRDQTLFSTIEDFLWFKLSAVRDCPSGPSSIVLRDGLVPYSLDDLQTYLNKFEPSYYTKNGKDPMVYPYILLLSIQLLPAVLYMSKETGDEGYNVDAAHLSIVLADHGILSEGARQKLGVMDAYAEVSTIIRQYGSMYLRLDDLQMALEYYAQAAAAVGGGQLSWTGRGNVDQQRQRSLMLKQLLTEILLRDGGIFLLLGPRGAGEEGQLGRFVTDPKARQQFLIEAACQCQEAGMYNKSIEIQKRVGSFSMALDTINKCLSEAICALFRGRLDGESQTAGLIHSGNEILETYHYHPDVSLQERDHVFEQQTVLRQLESILSIHKLARVGHHVEALREIAKLPFLPLDPRGPDIAVDVFENLSPHVQVCIPDLLKVALTCLDNVTDSDGSLRALRAKIASFIANNMKRNWPRDLYERVAQRL

SEQ ID NO: 14231 - protein, 858 aa, Lupinus angustifolius
MANEDLSNWSDLLHSSTKLLEQAAPSAQFPPLQRNLDQLEALSKKLKSKTLRAEAPSQSIAATRLLAREGINAEQLARDLKSFELKTTFEDVFPVEATSVEEYLQQVHEMAMVSAVQEAQKDNLRSFNDYMMKVFEEDWQKEKRDFLQSLNRISSLPRTNTTATSSTGTRSGQIVPTASSPQVSYGMEVVPLTSRPIMEKKASVYAEVVKNLNKARECGLPFKPAASFKGAYESLGIDAGGGKSVTMRKIWHLVQMMMDGDSTQQHVSERMSLTIGARRHLELGHEKYIMDTIHSHPAQAALGGSVGNLQRIRAFLRIRLRDYGLLDFDAGDARRQPPVDTTWQQIYFCLRSGYYDEARNVSLSSRASHQFSPLLTEWINTGGVVPEEIASAASEECERMLRTGDRVGRAAYDKKKLLLYAIISGSRRHVDRLLRDQPTLFSTIEDFLWFQLSAVRDCSSGPSSIVLSDGLVPYTLDDLQIYLNKFEASYYTKNGKDPLVYPYILLLSIQLLPAVLYMSKETGDEGYNIDAVHLSVVLADHGFLSEGAGAGHKLGVMDAYAEVSTIVRQYGSMYLRLGDLQMALEYYAQAAAAVGGGQLAWTGRGNVDQQRQRNLMLKQLLTELLLRDGGIYLLLGARGAGEEGELGRFVTDPKARQQFLIEAACQCQEAGMYDKSIEIQKRVGSFSMALDTINKCLSEAICALFRGRLDGESRTAGLIHSGNEILETYTYYPDVSLQERENVFEQQNVLRQLESVLSIHKLARLGNYVDAIREVAKLQFLPLDPRGPDIANDVFENLSPHVQACIPDLLKVALTCLDNVTDSDGSLRALRAKISNFIANNLKRNWPRDLYERVAQRL

SEQ ID NO: 14232 - protein, 856 aa, Lupinus angustifolius
MANEDISNWSDLLHSSTKLLEQAAPSAQFPPLQRNLDQLEALSKKLKSKTLRNEAPSQSIAATRLLAREGINAEQLAKDLKSFELKTTFEDVFPVEATSVEEYLQQVHEMAMVSAVQEAQKDNIRSFNNYMMKVLEEDWQKEKRDFLQSLNRISTLPRTNMNANSNVGTRPGQIVSIASSPQVSSGMEVVPLTSRPIMEKKASIYAEVVKNLNKSRERGLPFKPAASFKSAYESLDIDGGGGKSVTMRKIWHLVQMMMDGDPTQQRVSIRMSLTIGARRHLELGHEKYIMDTIHSHPAQAALGGGVGNLRRIRAFLRIRLRDYGLLDFDAGDARRQPPVDTTWQQIYFCLRSGFYDEARNVALSSRAAHQFSPLLTEWINTGGMVPEEIASAASEECERMLRTGDRVGRAAYDKKKLVLYAIISGSRRHIDRLLRDQPTLFSTIEDFLWFQLSAVRDCPSGPSSIVLSDGLVPYSLDDLQIYLNKFEPSYYTKNGKDPLVYPYILLLSIQLLPAVLYMSKETGDEGYNIDAVHLSIVLADHGFLSEGAGHKLGVMDVYAEVSTIIRQYGSMYLRLCDLQMALEYYAQAAAAVGGGQLSWTSRGNVDQQRQRSSMLKQLLTELLLRDGGIYLLLGARGSGEEGELGRFVTDPKARQQFLIEAAFQCQEAGMYDKSIEIHKRVGSFSVALDTINKCISEAISALFRGRSDGESRTAGLIHSGNDILETYTYYPDVSLQERQLVFEQQNVLRQLESVLSIHKLARLGNYVDAIREVAKLQFLPLDPRGPDIAINVFENLSPHVEACIPDLLKVALTCLDNVTDSDGSLRAFRAKISSFIANNLKRNWPRDLYERVAQRL

SEQ ID NO: 14233 - protein, 865 aa, Theobroma cacao
MASEQDMSSWTDLLHSSSKLLEQAAPSAQFPPLQRNLDQLEALSKKLKAKTLRTEAPSRSIAATRLLAREGINAEQLTRDLKSFELKTTFEDVFPAEATSVEEYLQQVHEIAMVSAIQEAQKDNLRSFNDYMMKVLEEDWQNEKRDFLQSLSRISTLPKTNMLDKSITGARSGQIVSMASSPQVSSGPSGMELLPLANKPVVEKKVSVYAEVVRNLNNARQQGLPFKPATAFKAAYESLGTEASSGKSVNMQKMWHLIQTLMGEDSTMQRSVSRKMSLVIGARRHLEWGHEKYIMDTVQSHPAQAALGGAVGNLHRVHAFLRIRLRDYGILDFDAGDARRQPPVDTTWQQIYFCLRTGYYDEARQVAQSSRASHQFAPLLTEWINSGGMVPADIAVAAAEECEKMFRMGDRVGRAAYDKKKLLLYAIISGSRRQVDRLLRDLPSLFSTIEDFLWFILSAVRDLPGGTSSVILNEGLVPYSLDDLQAYLNKFEPSYYTKNGKDPLVYPYVLLLSIQLLPAVSYLSKETGDEGYNIDAAHIAIVLADNGVLYEGAGAGAGKKLGMMDAYAEASSIIRQYGSMYIRLGNLQMALEYYAQAAAAVGGGQVSWTGRGNVDQQRQRHLMLKQLFTELFLRDGGIYLLLGSRGAGEEGELGRFLTDHKARQQFLLEAARHCQDAGLYEKSIEIQKRVGAFSMALDTINKCLSEAICALSCGRLDGESRTAGLIHSGNEILETFKYYPEVSLQEREHVLEQQTVLRQLEAILSIHKLTRLGQYLDAVREVAKLPFLPLDPRAPDVTSNAFENLSPHVQACVPDLLKVALTCLENVTDTDGSLRAMRAKIATFLANNMHQNWPRDLYETVARRL

SEQ ID NO: 14234 - protein, 863 aa, Vitis vinifera
MATDSDMSSWTDLLHSSTKLLEQAAPSAQFPPLQRNLDQLEALSKKLKSKTLRAEAPSQSVAATRLLAREGLNAEQLARDLKSFELKTTFEDVFPAEATSVEEYLQQVHEMAIVSAIQEAQKDNLKSFNDYMMKVMEEDWQKEKRDFLQSLSRISTLPKTNISDSSTGATRPGQIASMISSPQVSSGLSSMELVPLANKPVLEKKTSVYAEVVKNLNSARERGLPFKPATAFKGAYDSLGLETSGGKSVNMQKIWHLIQTLMGEDTAAQWNVSKKMSLVIGARRHLEWGHEKYMIDTIQSHPAQAALGGVVGNLQRIHAFLRIRLRDYGVLDFDAGDARRQPPVDTTWQQIYFCLRTGYYEEAIEVARSSRVSNQFASQLTEWITTRGMVSAEIAAVASEECDKMLRMGDRVGRAAYDKKRLLLYAIISGSRRHIDRLLRDLPTLFNTIEDFLWFKLSAVRDCPGGSSSVVLNEGLVPYSLDDLQNYLNKFEPSYYTKNGKDPLVYPYVLLLSIQLLPAVLYLSKEMGVEGYNVDATHISIVLADHGVLSEGAGVGQKLGVMDAFAEASSIIRQYGSVYLRAGDLSTALEYYAQAAAAVGGGQLSWTGRGNIDQQWQRNLMLKQLLTELLLRDGGIYLLLGPRGAGEEGELARFLTDVKARQQFLLEASRQCQDAGLYDQSIEIQKRIGAFSMALDTINKCLSEAVCALARGRLDGESRTAGLIQSGNEILETYKYFPEVSLQEREHVMEQQTVLRELEAILSIHKLARVGHYLDALREVAKLPFLPLDPRAPDTTPDVFQNLSPHVQACVPDLLKIALSCLDYVTDTDGSLRALRTKIANFLANNLNRNWPRDLYEKVARTL

SEQ ID NO: 14235 - protein, 865 aa, Theobroma cacao
MASEQDMSSWTDLLHSSSKLLEQAAPSAQFPPLQRNLDQLEALSKKLKAKTLRTEAPSRSIAATRLLAREGINAEQLTRDLKSFELKTTFEDVFPAEATSVEEYLQQVHEIAMVSAIQEAQKDNLRSFNDYMMKVLEEDWQNEKRDFLQSLSRISTLPKTNMLDKSITGARSGQIVSMASSPQVSSGPSGMELLPLANKPVVEKKVSVYAEVVRNLNNARQQGLPFKPATAFKAAYESLGTEASSGKSVNMQKMWHLIQTLMGEDSTMQRSVSRKMSLVIGARRHLEWGHEKYIMDTVQSHPAQAALGGAVGNLHRVHAFLRIRLRDYGILDFDAGDARRQPPVDTTWQQIYFCLRTGYYDEARQVAQSSRASHQFAPLLTEWINSGGMVPADIAVAAAEECEKMFRMGDRVGRAAYDKKKLLLYAIISGSRRQVDRLLRDLPSLFSTIEDFLWFILSAVRDLPGGTSSVILNEGLVPYSLDDLQAYLNKFEPSYYTKNGKDPLVYPYVLLLSIQLLPAVSYLSKETGDEGYNIDAAHIAIVLADNGVLYEGAGAGAGKKLGMMDAYAEASSIIRQYGSMYIRLGNLQMALEYYAQAAAAVGGGQVSWTGRGNVDQQRQRHLMLKQLFTELFLRDGGIYLLLGSRGAGEEGELGRFLTDHKARQQFLLEAARHCQDAGLYEKSIEIQKRVGAFSMALDTINKCLSEAICALSCGRLDGESRTAGLIHSGNEILETFKYYPEVSLQEREHVLEQQTVLRQLEAILSIHKLTRLGQYLDAVREVAKLPFLPLDPRAPDVTSNAFENLSPHVQACVPDLLKVALTCLENVTDTDGSLCAMRAKIATFLANNMHQNWPRDLYETVARRL

SEQ ID NO: 14236 - protein, 863 aa, Cucumis sativus
MANDQDMSGWTDLLHSSTKLLEQAAPSAQFPPLQRNLDQLEVLSKKLKAKTLRTEAPTQSIAATRLLAREGINAEQLARDLKSFELKTTFEDVFPAEATSIEEYLQQVHEMAMISAIQEAQKDNVRSFNDYMMRVLEEDWKKEKRDFLQSLSRISTLPRTNMIDDKSGASKTGQISSFVSSAHVSSGVPSLESVSLANKPIIEKKASTYGEVVKKMNDARERGLPFKPAVAFKGAYESLDLHASAGKSVNMQKIWHLIQTLMGEESTSKRNISKKMSLILGARRHLEWGHEKYIMDTIQSHPAQAALGGVVGNLQRIRAFLRIRLRDYGVLDFDANDARRQPPVDTTWQQIYFCLRTGYYDEARNIALSSRASNQFAPLLTEWINTGGMVPVDIASVASEECEKLLRMGDRMGRAAYDKKKLLLYAIISGSRRQIDRLLRDLPMLFNTIEDFLWFQLSAVRNGHGESSSIVLNEGSVPYTLDDLQFYLNKFEPSYYTKNGKDPLVYPYVLLLSIQLLPAVLYLSKETGEEGLNIDAAHISIVLADNGVLSEGTGAGQKLGVMDPYAEVASIIRQYGSLYLRMGNLSMALEYYAQAAAALGGGQLSWSSRGSMDQQRQRTLMLKQLLTELLLRDGGIYLLLGARGAGEEGELRRFMTDMKSRQQFLLEAARQCQEAGLYDKSIEIHKRVGAFSMALDTINRCLSEAICALSRGRLDGESRTAGLIHSGNDILEAYKYCREISLQEREYVMEQQTVLRQLEAVLSIHKLARLGHHLDALREIARIPFLPLDPRGPDMASDVFQNLSPHIQACVPDLLKVALTCLDNVTDSDGSLRALRAKIANFIANNLNRNWPRDLYEKVAQTL

SEQ ID NO: 14237 - protein, 863 aa, Malus domestica
MATEQNMSSWTDLLHSSTKLLEQAAPSAQFPPLQRNLDQLETLSKKLKAKTLRNEAPQQSVAATRLLAREGLNAEQLARDLKSFELKTTFEDVFPSEATTVEEYLQQVHQMAMVSALQEAQKDNLRSFNDYMLKVLEEDWQKEKRDFLQSLSQISTLPRTNMTYTSSSGSRSGQIASITSSRQVSSSPSSMELVPLASKPIRDKKASVYAEVVKILNNARQHGLPFKPATAFKGAYESLGLDVSGGKSVNMQKIWHLLQTLMGEDITLPRSVSKRMSLVIGARRHLEWGHEKYIMDTIQSHPGQAALGGVVGNLQRIRAFLRIRLRDYGVLDFDAGDTRRQPPVDTTWQQIYFCLRTGYYDEARSVALSSRASHQFAPLLTEWINTGGMVPASIAASASEECEKMLRMGDRVGRAAYDKKKLLLYALVSGSRRQIDRLLRDLPTLFNTIEDFLWFKLSAVRDCPGGAAPIVMNESLVPYTLDDLQMYLNKFDPSYYTKNGKDPLVYPYVLLLSIQLIPGMVYLFKETGDEGYNIDAAHISIVLADHGFLSEGAGAGQKMGLMDAYAEASSIIRQYGSVYLRLGNLSVALEYYAQAAAAVGGGELSWSGRGNVDQQRQRNLMLKQLLTELLLRDGGIYLLLGSRGAGEEGELGRFLTDVKTRQQFLLEAAHQCQEAGLYEKSIEIQKRIGAFSMALDTINKCLSEAICALSRGRLDGESRTAGLIHSGNEILEMHKYFPDISPQERESVSEQYIVLRQLEAVLSIHKLARGGHYADALREVARLQFLPLVPGTPDVTTDVFQNLSPHVQACVPDLLKVALTCLDNMVDSDGSLRALRAKIASFIANNSNRNWPRDLYEKVARSL

SEQ ID NO: 14238 - protein, 857 aa, Prunus mume
MATDQNMSSWTDLLHSSTKLLEQAAPSAQFPPLQRNLDQLETLSKKLKAKTLRTETPQQSIAATRLLAREGLNAEQLARDLKSFELKTTFEDVFPSEATTVEEYLQQVHQMTMVSALQEAQKDNLRSFNDYMLKVLEEDWQKEKRDFLQSLSQISTLPRTNMTYTTSAGSRSGQIASITSSPQVSSTPSGMEVEPLASKPILEKKTSVYAEVVKNLNNARQRGLPFKPASAFKGAYESLGLDASGGKSVNMQKIWHLLQTLMGEDITIQRGASKRMSLVIGARRHLEWGHEKYIMDTIQSHPAQAALGGVVGNLQRIRAFLRIRLRDYGVLDFDAGDARRQPPVDTTWQQIYFCLRTGYYDEARAVALSSRVSNQFAPLLTEWINTGGMVPAEIAAAASEECEKMLRTGDRVGRAAYDKKKLLLYALISGSRRQIDRLLRDLPTLFNTIEDFLWFKLSAVRDCPGGAAPIVMNESLVPYTLDDLQIYLNKFDPSYYTKNGKDPLVYPYVLLLSIQLIPGVVYLSKETGDEGYNIDAAHISIVLADHGVLSEGAGAGQKMGVMDAYAEASSIIRQYGSVYLRLGNLQMALEYYAQAAAAVGGGQLSWSGRGNVDQQRQRNLMLKQLLTELLLRDGGIYLLLGSRGAGEEGELGRFLTDVKERQQFLLEAAHQCQEAGLYEKSIEIQKRIGAFSMALDTINKCLSEAICALSRGRLDGESRTAGLIHSGNEILEMHKYYPEISPQERESVSEQHIVLRQLEAVLSIHKLARGGHYADALREVARLPFLPLDPRTPDATTDVFQNLSPHVQACVPDLLKVALTCLDNMVDSDGSLRALRAKIASFIANNSSSPPPPPPFV

SEQ ID NO: 14239 - protein, 860 aa, Gossypium raimondii
MASEQGMSSWTDLLHSSTKLLEQAAPSAQFPPLQRNLDQLEALSKKLKAKTLRTEAPSQSIAATRLLAREGINAEQLTRDLKSFELKTTFEDVFPAEATSVEEYLQQVHEMAMVSAIQEAQKDNLRSFNDYMMKVLEEDWQKEKRDFLQSLSRISTLPKTNMIDKSSGGIRSGQMVPMASSSQVSSGPSAIGLLPLADKPVVEKKVSVYAEVVRNLNNARQQGLPFKPATAFKVAYESLGTEASGGKSVNMQKMWHLILKLMGEDSMMRQSVSRKMSLVIGARRHLEWGHEKYIMDIIQSHPAQAALGGAVGNLHRVRAFLRIRLRDYGLLDFDAGDARRQPPIDTTWQQIYFCLRTGYYDEARQVALSSRASHQFAPLLAEWINGGGMVPAHTAAAAAEECEKMFRMGDRVGRASYDKKKLLLYAIISGSRRQIDRLLRDIPSLFSTIEDFLWFILSAVQDFPGGTSSNEGLVPYSLDDLQAYLNKFEPSYYTKNGKDPLVYPYILLLSIQLLPAISYLSKEAGEEEYHIDAAHIAIVLADNGVLSEVSGAGQKLGVMDAYAEASSIIRQYGSMYLRLGNLQMALEYYAQAAAAVGGGHVSWTGRGSVDQQRQMNLMLKQLLTEILFRDGGVYLLLGSRGAGEEGELRRFLTDHKARQQFLLEAARQCQDSGLYDKSIEIQKRIGAFSMALDTINKCLSEAICALSRGRLDGESQTAGLIHSGNEILETFKYYPEVSFQEREHVSEQQTILRQLETILSIHKLTRLGQYLDALREVAKIPFLPFDPRAPDTSADVFQNLSPHVQACLPDLLKVAITCLDNVSDTDGSLRAMRSKIATFLANNMRQNWPRDLYEKVAKSL

SEQ ID NO: 14240 - protein, 860 aa, Gossypium raimondii
MASEQGMSSWTDLLHSSTKLLEQAAPSAQFPPLQRNLDQLEALSKKLKAKTLRTEAPSQSIAATRLLAREGINAEQLTRDLKSFELKTTFEDVFPAEATSVEEYLQQVHEMAMVSAIQEAQKDNLRSFNDYMMKVLEEDWQKEKRDFLQSLSRISTLPKTNMIDKSSGGIRSGQMVPMASSSHVSSGPSASGLLPLADKPVVEKKVSVYAEVVRNLNNARQQGLPFKPATAFKVAYESLGTEASGGKSVNMQKMWHLILKLMGEDSMMRQSVSRKMSLVIGARRHLEWGHEKYIMDIIQSHPAQAALGGAVGNLHRVRAFLRIRLRDYGLLDFDAGDARRQPPIDTTWQQIYFCLRTGYYDEARQVALSSRASHQFAPLLAEWINGGGMVPAHAAAAAAEECEKMFRMGDRVGRASYDKKKLLLYAIISGSRRQIDRLLRDIPSLFSTIEDFLWFILSAVQDFPGGTSSNEGLVPYSLDDLQAYLNKFEPSYYTKNGKDPLVYPYILLLSIQLLPAISYLSKEAGEEEYHIDAAHIAIVLADNGVLSEVSGAGQKLGVMDAYAEASSIIRQYGSMYLRLGNLQMALEYYAQAAAAVGGGHVSWTGRGSVDQQRQMNLMLKQLLTEILFRDGGVYLLLGSRGAGEEGELRRFLTDHKARQQFLLEAARQCQDSGLYDKSIEIQKRIGAFSMALDTINKCLSEAICALSRGRLDGESQTAGLIHSGNEILETFKYYPEVSFQEREHVSEQQTILRQLETILSIHKLMRLGQYLDALREVAKIPFLPFDPRAPDTSADVFQNLSPHVQACLPDLLKVAITCLDNVSDTDGSLRAMRSKIATFLANNMRQNWPRDLYEKVAKSL

SEQ ID NO: 14241 - protein, 840 aa, Citrus clementina
MAGEQDMSGWTDLLHSSTKLLEQAAPSAQFPPLQRNLDQLEALSKKLKAKTIRTETPSQSIAATRLLAREGINAEQLARDLKSFELKTTFEDVFPTEATSVEEYLQQVHEVAMVSAIQEAQTDNLRSFNDYMMKVLEEDWQKEKRDFLQSLSRISTLPKTNMTDTSTGGTLPGQMASMASSPQISSGPSGMELVPLANKPLLEKKATVYAEVVKNLNNARQQALPFKPATAFKGAYESLAIESSSGKSVNIQKIWHLLQTMMGEHATVQQTASRKMSLVIGARRHLEWGHEKYIMDTIQSHPAQAALGGVVGNLQRVRAFLRIRLRDYGVLDFDTGDTRRQPPVDTTWQQIYFCLRTGYYDEARNVALSSRASNQFAPLLTEWINTGGMVPPEIAAAASEECDKMLRMGDRVGRAAYDKKKLLLYAIISGSRRQIDRLLRDLPTLFGTIEDFLWFKLSAIRDVPSEAPSVVLSDGLAPYSLDDLQVYLNKFDPSYYTKNGKDPLVYPYVLLLSIQVLPAVLYLSKESGDEGYNIDAAHISIVLADHGVLSEGSGAGKKLGLMDPYAEASSIIRQYGSAYLRLGNLQMALEYYAQAAAAVGGGQLSWTGRANVDQQRQKSLMLKQLLTELLLRDGGIYLLLGSRGAGEEGELGRYITDLKARQQFLLEAAGQCQEAGLYDKSIELQKRVGAFSMALDTINKCLSEAIFAMSRGRLDGESQTASLIHSGNEILEMEKYYPEVSLHEREQVLEQQTVLRQLEAILSVHKMARSGHYLDALREVAKLPFLPFDPRVPDAMVDVFQSLSPHVQACVPDLLRVALTCLDNVTDTDGSLRAMRAKVC

SEQ ID NO: 14242 - protein, 657 aa, Glycine max
MEDTLSALRSLMLSQSPPLDALVVPSEDYHQSEYVSARDKRREFVSGFTGSAGLALITKNEALLWTDGRYFLQAEQELSAQWKLMRIGEDPAVDIWMADNLPKEASIGVDPWCISIDTAQRWERAFAEKQQKLVPTSKNLVDEVWINRPQPQINAVIVHPLKFAGRSVADKLKDLRKKLVHEQARGIIFTALDEVAWLYNIRGSDVAYCPVVHAFAIVTSNSAFIYVDKRKVSVEVQAHLVENGIEIREYTAVSSDTTLLATDELDSVSTAKVALAETEVRKIPNETAKHANGEHQAEENSNDLIWADPGSCCYALYAKLNPDTVLLHQSPLALAKALKNSVELDGLKKAHIRDGAAVVQYLVWLDKKMQDILGASGYFLENDSVKKEKHLQSLKLTEVTVSDQLEGFRASKEHFRGLSFPTISSVGPNAAIIHYSPKAETCAELDPDKIYLFDSGAQYLDGTTDITRTVHFGKPSTHEKACYTAVLKGHIALGNARFPNGTNGHSLDILARIPLWKDGLDYRHGTGHGIGSYLNVHEGPHLISFRPQARNVPLQSSMTVTDEPGYYEDGEFGIRLENVLIVKEAGTNFNFGDRGYLSFEHITWAPYQTKLIDLNLLCPEEIDWLNSYHSTCRDILAPYLNEVENAWLKKATEPVGA

SEQ ID NO: 14243 - protein, 640 aa, Cajanus cajan
MEDTLSKLRSLMASHSPPLDALVVPSEDYHQSEYVSARDMRRQFVSGFTGSAGLALITKNEALLWTDGRYFLQAEQELSDQWKLMRIGEDPAVDTWMADNLPKEASIGVDPWCISIDTAQRWERAFAEKQQKLVQTTKNLVDEVWINRPPEEINAVIAHPLKFAGRSVADKLKDLRKKLLQEQARGIIFTALDEVAWLYNIRGSDVAYCPVVHAFAIVTSNSAFIYVDKRKVSAEVQTHLVENGIEIREYRAVSSDVTLLATDELDAISTDKRVNGEHQAQENKNDLIWADPGSCCYALYAKLNPDTVLLQQSPLALAKALKNSVEMDGLKKAHIRDGAAVVQYLVWLDKKMQDIYGASGYFLEKDSVKKEKHLQSGKLTEVTVSDQLEGFRASKEHFRGLSFPTISSVGPNAAIIHYSPKAETCAELDPDKIYLFDSGAQYLDGTTDITRTVHFGKPSAHEKACYTAVLKGHIALGNARFPNGTNGHALDILARIPLWKDGLDYRHGTGHGIGSYLNVHEGPHLISFRPHARNVPLQSSMTVTDEPGYYEDGEFGIRLENVLIIKEADTKFNFGDKGYLSFEHITWAPYQAKLIDLNRLNPDEINWLNSYHSTCRDILAPYLDEVENAWLKKATEPVAA

SEQ ID NO: 14244 - protein, 639 aa, Phaseolus vulgaris
MEDTLSGLRSLMATHSPPLDALVVPSEDYHQSEYVSARDKRREFVSGFTGSAGLALVTKNEALLWTDGRYFLQAEQELSAQWKLMRIGEDPSVDIWIADNLPKEAFIGVDPWCISIDTAQRWERAFSEKQQKLVQTTKNLVDEVWKNRPQAEINAVIVHPLKFAGRSVADKLKDLRKRLLQEQARGIIFTALDEVAWLYNIRGSDVDYCPVVHAFAIVTINTAFIYVDKRKVSVEVQAHLVENEIEIREYTDVSSDVTLLATDELDTVSTVKRVNGGHQAEENSNLIWADSGSCCYALYAKLNPDTVLLQQSPLALAKALKNSVELDGLKKAHIRDGAAVVQYLVWLDKKMQDVYGASGYFLEKDSVKKEKQLQSLKLTEVTVSDQLESFRASKEHFKGLSFPTISSVGPNAAIIHYSPKAEACAELDPDKIYLFDSGAQYLDGTTDITRTVHFGKPSTHEKACYTAVLKGHIALGNARFPNGTNGHALDILARIPLWKDGLDYRHGTGHGIGSYLNVHEGPHLISFRPHARNVPLQSFMTVTDEPGYYEDGAFGIRLENVLIVKDADTKFNFGDKGYLSFEHITWAPYQAKLIDLKLLSPDEINWLNSYHSTCRDILAPYLDEVESAWLKKATEPIGA

SEQ ID NO: 14245 - protein, 659 aa, Arachis hypogaea
MEDTLSALRSLMSSHSPSLDALVVPSEDYHQSEYVSARDKRREFVSGFSGSAGLALITAKEALLWTDGRYFLQAEQQLSDQWKLMRIGEDPAVDVWMADNLPKDASIGVDPWCISVDTAQRWERAFAEKHQKLVQTTKNLVDEVWAKRPPEQINAVIVHPLEFAGRSVADKLQDLRKRLAQERARGIIFTALDEVAWLYNIRGSDVAYCPVVHAFAIVTTNSAFLYVNKEKVSVEVKTHLEENGIGIRDYTAVSSDAALLATDELDALSTAKGSLAAVTKEAEKTHNELNKGVNGEHLAEEHSNDFVWVDPGTCCYALYSKLNSQTVILQQSPLALAKALKNPVELDGLRKAHVRDGAAVVQYLVWLDKKMQEIYGASGYFLEGNSVKKEKGLESLKLTEVTASDKLEGFRASKEHFRGLSFPTISSVGSNAAIIHYSPQAETCAELDPDKIYLVDSGAQYLDGTTDITRTVHFGKPSAHEKACYTAVLKGHIALGNARFPNGTNGHALDILARVPLWKDGLDYRHGTGHGIGSYLNVHEGPHLISFRPQARNVPLQSSMTVTDEPGYYEDGNFGIRLENVLIVNEADTKFNFGDKGYLSFEHITWAPYQTKLIDLNLLMPDEISWLNAYHSKCRDILAPYLDVAENAWLQKATEPVAV

SEQ ID NO: 14246 - protein, 140 aa, Arachis hypogaea
MEDTLSALRSLMSSHSPSLDALVVPSEDYHQSEYVSARDKRREFVSGFTGSAGLALITAKEALLWTDGRYFLQAEQQLSDQWKLMRIGEDPAVDVWMADNLPKDASIGVDPWCISVDTAQRWDVLLLKNVRSWPQRQKIW

SEQ ID NO: 14247 - protein, 655 aa, Cicer arietinum
MADTLSALRSLMASHSPPLHALVVPSEDYHQSEYVSGRDKRRQFVSGFTGSAGLALITKDEALLWTDGRYFLQAEQQLSDQWKLMRMAEDPAVDIWMADNLPKDAAIGVDPWCISIDTAQRWERAFAKNQQKLVQTTKNLVDEVWTNRPPAEINAVTVQPLKFAGRSVTDKLKDLRKKLVQEHARGIIFTTLDEVAWLYNIRGNDVAYCPVVHAFAIVTSNSAFIYLDTRKLSIEVKTHLEENGIEIKEYTSVSFDVALLATDELDSVSTGTLAEVSKESAKIPSETHKSVNGKHQAGENSSNFIWADPGSCCFALYSKLNPDTVLLQQSPLALPKALKNPVELDGLRKAHIRDGAAVVQYLVWLDKKMQEIYGASGYFLEENSVKKEKHLKPLKLTEVTVSDKLEEFRASKEHFRGLSFPTISSVGPNAAIIHYSPQADTCAELDPDKIYLFDSGAQYLDGTTDITRTVHFGRPSDHEKSCYTAVLKGHIALGNAKFPNGTNGHTLDILARIPLWNYGLDYRHGTGHGIGSYLNVHEGPQLISFRIRNVPLQSSMTVTDEPGYYEDGEFGIRLENVLIVKEADTKFNFGDKGYLSFEHITWAPYQTKLIDLNLLNPEEINWLNSYHSKCRDILAPYLDEAENAWLKKATQPVAV

SEQ ID NO: 14248 - protein, 659 aa, Lupinus angustifolius
MTETLSALRSLMASHSPPLHALIVPSEDYHQSEYVSERDMRRRFVSGFSGSAGLALITKNEALLWTDGRYFLQAEQELSDQWKLMRLGEDPPVDIWMADNLPKDASIGVDTWCISIDTAQRWERAFSGKQQKLVETTKNLVDEVWINRPPAEINAVTIQPLKFAGRSVGDKLKDLRKKLVQEQARGIIFTALDEVAWLYNIRGSDVAYSPVVHAYAIVTSNSAFIYVDKQKVSAEVKSHLEENGIEIKDYTAVSSDVALLAYNKPAAGPTANGALAEVTKEAGKTSSETNSSINSNHQAEEKSNDLIWADPGSCCYALYLKLNADTVLLQQSPLALAKALKNPVELEGLRNSHIRDGAAVVQYLVWLDKQLQDNYGASGYFLEGNAVKKENHLQSLKLTEVTASDKLEGFRASKEHFRGLSFPTISSVGANAAIIHYKPQAETCAELDPDKIYLFDSGAQYLDGTTDITRTVHFGKPSAHEKACYTAVLKGHIALGNATFPNGTTGYSLDILARIPLWKYGLDYRHGTGHGVGSFLNVHEGPHLISFRPQVRSVPLQSSMTVTDEPGYYEDGNFGIRLENVLVVNEADTKFNFGDKGYLSLEHITWAPYQTKLIDLNLLLPDEINWLNSYHKTCRDILAPYLDEAENAWLKKATEPIGV

SEQ ID NO: 14249 - protein, 655 aa, Medicago truncatula
MADTLSALRSLMSSHSPPLHALVVPSEDYHQSEYVSARDKRRAFVSGFTGSAGLALITKDEALLWTDGRYFLQAEQQLSDQWKLMRLAEDPAVDIWMADNLPKDAAIGVDPWCISIDTAQRWERAFAKKQQKLVQTTKNLVDEVWTTRPPAEINAAVVQPLKFAGRSVTDKLKDLRKKLAQEHARGIVLTALDEVAWLYNIRGKDVAYCPVVHAFAIVTSNSAFIYVDKRKVSIEVKTHLEENGIEIKEYTEVSLDAAFLATNELDSVSTAKASLAEVTKQSENSETNKSVNGKHQTGEKCSNLIWADPASCCYALYSKLNPDAVVLQQSPLALPKALKNPVELDGLRKAHVRDGAAVVQYLVWLDNKMQDIYGASGYFLEENTVKKEKPLKSLKLTEVTVSDKLEEFRASKEHFRGLSFPTISSVGPNAAIIHYSPQAETCAELDPDKIYLFDSGAQYLDGTTDITRTVHFGRPSDHEKACYTAVLKGHIALGNARFPNGTNGHQLDILSRIPLWNYGLDYRHGTGHGIGSYLNVHEGPHLISFRIRNVPLQASMTVTDEPGYYEDGAFGIRLENVLVINEADTKFNFGDKGYLSFEHITWAPYQTKLIDLNLLNPEEKNWLNSYHSKCRDILAPHLDEAGNAWLKKATEPVAV

SEQ ID NO: 14250 - protein, 657 aa, Trigonella foenum-graecum
MADTLSALRSLMSSHSPPLHALVVPSEDYHQSEYVSARDKRREFVSGFSGSAGLALITKDEALLWTDGRYFLQAEQQLSDQWKLMRMAEDPAVDIWMADNLPKDAAIGVDPWCISIDTAQRWERAFAKKQQKLVQTTKNLVDEVWTTRPPAEINAAVVQPLKFAGRSVTDKLKDLRKKLAQEHARGIVLTALDEVAWLYNIRGKDVAYCPVVHAFAIVTFNSAFIYVDKRKVSIEVKTHLEENGIEIKEYTEVSLDAALLATNELDSVSTAKASLAEVTKQSENFASETNKSVNGKHQTREKSSNLIWADPASCCYALYSKLNPDAVCLLQSPLALSKALKNPVELDGLRKAHVRDGAAVVQYLVWLDNKMQDIYGASGYFLEENTVKKEKHLQSLKLTEVTVSDKLEEFRASKEHFRGLSFPTISSVGPNAAIIHYSPEAETCAELDPDKIYLFDSGAQYLDGTTDITRTVHFGRPLDHEKRCYTAVLKGHIALGNARFPNGTNGHQLDILSRIPLWKYGLDYRHGTGHGIGSYLNVHEGPQLISFRIRNVPLQASMTVTDEPGYYEDGAFGIRLENVLVINQADTKFNFGDKGYLSFEHITWAPYQTKLIDLNLLNPEEKNWLNSYHSKCRDILAPHLDEAENAWLKKATEPVAV

SEQ ID NO: 14251 - protein, 625 aa, Lupinus angustifolius
DYHQSEYVSERDMRRRFVSGFSGSAGLALITKNEALLWTDGRYFLQAEQELSDQWKLMRIGEDPPVDIWMADNLPKDASVGVDTWCISIDTAQRWERAFSGKQQKLVETTKNLVDEVWINRPPAEINAVTIQPLKFAGRSVGDKLKDLRKKLVQERARGIILTALDEVAWLYNIRGSDVAYCPVVHAYAIVTSNSAFIYVDKRKVSVEVKSHLQENGIEIKDYTSVSSDVALLANNKPDALAEVTKEARETSSETNNSVNSNHQAEEKSNDLIWADPGSCCYALYLKLNADTVLLQQSPLALAKALKNPAELEGLRNSHIRDGAAVVQYLVWLDKQLQDNYGASGYFLEGNAVKKEKHLQSFKLTEVTASDKLEGFRASKEHFRGLSFPTISSVGANAAIIHYKPEAETCAELDPDQIYLFDSGAQYLDGTTDITRTVHFGKPSAHEKACYTAVLKGHIALGNARFPNGTTGYSLDILARIPLWKDGLDYRHGTGHGVGSFLNVHEGPHLISFRPQVRTVPLQSSMTVTDEPGYYEDGNFGIRLENVLVINEADTKFNFGDKGYLSFEHITWAPYQTKLIDLNLLLPDEINWLNSYHSTCRDILAPYLDEAENAWLKKATEPIVV

SEQ ID NO: 14252 - protein, 239 aa, Glycine max
MQTREYFLPDKMGLPLADETIDPHMHAPLASTFDAYLPPGVRQITPIERFKLLPSEACPKNFVIFDQTDQQSRIMFHPAMTYKFDSPSLHAHATGSQDFEKNKVNQMERELSSAFEEDPNDIDALLSIGADELEDFDEEEVSTARTREKYESLSDTCSSYCSKSRKKRSSSSSSVQKSSGAGGYCHNEGKHQEIKRMVRMLRKIVPDGGNQMDSVAVLNEAVKYLKSLKVEVEQFRVEP

SEQ ID NO: 14253 - protein, 242 aa, Cajanus cajan
MQTQEYFLPEKMVLPLEDEAIDAHMHVPFASSFDAFLPDAFLPPGVRQMTPFERFNLQPSEACPKNFIIFDQTDQQSRIMFHPAMTYNFSGPGLNVHATCQDFEKNKVIQMERELSTPFEEDPNDIDALLSIGADELEDFDEEEVSTARTHENYESISDTCSSYCSKSRKKRSSSSSVQKSSGEGGYGHNEGKHREMKRMVRMLRRIVPGGGNQMDSVAVLDEAVKYLKSLKVEMEQFGVGP

SEQ ID NO: 14254 - protein, 240 aa, Phaseolus vulgaris
MQTQEYFLPKKMVLPLADESIDADAHMHPPLASAFDAFLPPGVGQITPFERFKLQPSEACPKNFVIFDQTDQRSRIMFHPAMTYKFNSPGLDVDATFSQDFEKNKVNEMERELSSPFEEDPNDIDALMSIGGDELEDFDEEEVSTARTHEHYESLSDTCSSYCSKSRKKRVPSSCVHKCSEGRGCCHNDGNNREIKRMVRILRNIVPGGGNQMDSVTVLDEAVKYLKSLKVEVEQFGVGP

SEQ ID NO: 14255 - protein, 288 aa, Cajanus cajan
MRKKLDTRFPAARIKKIMQADEDVGKIALAVPVLVSKALELFLQDLCDRTYEITLQRGAKTMNALHLKHCVQSYNVFDFLRDIVSRVPDYGHGHGHGHSEAGADDRTLSKRRKAAGEEGNDSDEEAKRSKMRELGHTGTTGRGRGRGRGRGRGRGTRTVERDICHQQVESEPCTSIQHSSNDIPNTSVPLDNGPQSKELPKENFAVSEESTQSFRNIDLNANLNENEDKNASTAVQASLSEPTAMEIKHEEIPGWSLSDADKMAIDTMQLANLGNRLEEDEEDYDEEG

SEQ ID NO: 14256 - protein, 286 aa, Phaseolus vulgaris
MRKKLDTRFPAARIKKIMQADEDVGKIALAVPVLVSKALELFLQDLCDRTYEITLQRGAKTMNALHLKHCVQSYNVFDFLRDIVSRVPDYGHGHGHFEGGADDRALSKRRKAAGVEGNESDEESKRSKMRELGHTGTPGRGRGRGRGRGRGRGIRPVETDIGHQQVESEPCSSIQQISNDIPNTSLPIDNGVQSKECSKENFAAHEESTQSFRNIDLNANLNENEDKNASAAVQASVPEPADMDIKHEEIPGWSLSEVDKMAIDTMQLATLGSRLEEDDEDYDEEG

SEQ ID NO: 14257 - protein, 291 aa, Lotus japonicus
MRKKLDTRFPAARIKKIMQADEDVGKIALAVPVLVSKALELFLQDLCDRTYEITLQRGAKTMNALHLKHCVQSYNVFDFLRDIVSTVPDYGHGHGHGNSEGGADDRALPKRRKAAGDDGNDSDEEAKRSKMQLELGHTSSTGKGRGRGRGRGRGRGRGARTVEKETSVHQVESEPCTSIPESSKDFPDTSVAMYNDPESKELSKENIAVPEENAQSLRNIDLNANLNENEDKGASTAAQASLPEPAETEIKHEEIPGWSLSDVDKMAIDNMQLANLGSRVEDDEEDYDEEG

SEQ ID NO: 14258 - protein, 292 aa, Medicago truncatula
MKKKLDTRFPAARIKKIMQADEDVGKIALAVPVLVSKALELFLQDLCDRTYEITLQRGAKTMNALHLKHCVQSYNVFDFLRDIVSRVPDYSHGHGHSEAGADDRAVPKRRKAAGDDCNDSDEEAKRSKMLELGHTGSTGRGRGRGRGRGRGRGARTAERETLHQQVESEPCTSIQQTSKDVPNTSMAIDNGSEPKELSKENIAAHEESTQSLRNIDLNANLHENEEKNNTSTDIPTQAPLPEPAATTDMQHEEIPGWSLSDVDKMAIDTLQLAANLGNRLDEDEEDYDEEEE

SEQ ID NO: 14259 - protein, 1068 aa, Cajanus cajan
MECLKSPFIFSTPLVPPPFKKKKPRHVLIRCSVQRDPWSPSSGDPARPKPRTRSPKKPLSDDNARRIIKSKAAYLSVLRRNQGPQAQTPRWIKRTPEQMVQYLQDDRNGHLYGRHVVAAIKRVRSLSQRHDGDYDMRMEMASFVGKLTFKEMCTVLKEQKGWRQVRDFFAWMKLQLSYRPSVIVYTIVLRLYGQVGKLKLAEEIFLEMLDADCEPDEVACGTMLCSYARWGRHKAMLSFYSAVKERGIFLSVAVFNFMLSSLQKKSLHREVVEVWKDMLEKGVIPNSFTYTVAISSLIKEGLHEDAFKTFDEMRNNGIVPEEVTYSLLINLNTKIGNRDGVQRLYENMRIQGIIPSNYTCASLLSLYYKYEDYPRALSLFSEMVRNKISADEVIYGLLIRIYGKLGLYEDAHKTFEETKQRGLLSSEKTYLAMAQVHLTSGNVDKALEVIELMKSSNLWLSRFAYIVLLQCYVMKEDVISAEGTFVALSKTGPPDAGSCNDMLSLYMGLNLMNKAKEFIVRIREDGTHFDKELYRTVMKVYCKEGMLPEAEQLTNQMFKNESFKNDKFLMTFYWILCEHKGDAQSDNELAAIEPVDKFDATALGLMLSLYLTNGSFNKTKILLKLLGYAAGGSKIVSQLIISLSKDGEISKAELLNHQLIKLGCRMEEATVASLISHYGKQQMLKQAEDIFAEYVNSPTSSKLLYNSMINAYAKCGKQEKAYSLYKQVTEEGCDLGAVGISIAVNSLTNGGKHQEAENIVRRSLEENLELDTVAYNTFIKAMLEAGKLHFASSIFERMCSSGFAPSIETFNTMISVYGQDQKLDKAVEIFNKASSFGVSLDEKTYMNLIGYYGKAGMMLEVSQLFSKMQEEGIKPGKVSYNIMINVYANAGVLNETEKLFQAMQRQGCLPDSFTYLSLVQAYTRSLNYSKAEETIHDMQSKGIPPSCVHFNILLHAFTKAGLIDEAKRVYDKLSTFGLIPDLVCYRTMLNGYLKCGCVKEGINFFESIYESTKSDGFILSAAVHFYKSAGNESKAEEILSSMNNLRIPFLKKLEVGSDKLLLSEILGL

SEQ ID NO: 14260 - protein, 1070 aa, Phaseolus vulgaris
MECLKSPLLYLTPPSKPHPLVAKTKKKRPPPVLIRCSIKRDPWSPTFGDPTRPKPWTKNPKKPLSDDNARRIIKNKAAYQSILRRNQGPQAQTPRWIKRTPEQMVQYLQDDRNGHLYGKHVVAAIKKVRSLSQKVDGDYDMRMEMGSFVGKLSFKEMCVVLKEQKGWRQVRDFFYWMKLQLSYRPSVIVYTIVLRLYGQVGKLKLAEEIFLEMLDVDCEPDEVACGTMLCSYARWGHHRAMLSFYSAVKERGTILSVAVYNFMMSSLQKKSLHREVVQMWKDMVEKGVIPNSFTYTVSISSLVKEGLHEDAFKTFDEMRNNGVVPEEVTYNLLINISAKSGNRDEVQRLYEDMLFRGIVPSNYTCASLLSLYYKYEDYPRALSLFSLMVSNKIAADEVICGLLIRIYGKLGLYEDAQKTFEETNQRGQLTSEKTYLAMAQVHLASGKLDKALQVIELMRSSNLWFSRFAYIVLLQCYVMKEDVVSAEGTFVALSKTGPPDAGSCNDMLSLYVGLNLINKAKEFIIQIREDETHFDKELYRTVMRVYCKEGMLLEAEQLTYQMVNNESFRSDKFFKTFYWILCEYKGDAQSNDELVAIEPIEKFDATALGLMLSLFLTNDNFSKTNLLLKLLLGYASGGSKVVSQLIINLSKEGEISKAELLNHQLIKLGCRMEEAAVASLINHYGKQQMLKQAADIFAEYVNPSSSSKLLYNSMINAYAKCGKQEKAYLLYKQVTEEGHDLGAVGMSIAVNSLTNGGKHQEAENFIHSSLKDNLELDTVAYNTFIKAMLEAGKLQFASSIFDRMNSSGVSPSIETFNTMISVYGQDLKLDRALEMFNKASSFGLPPDEKTYMNLIGYYGKAGMILEASKLFSKMQEEGIKPGKVSYNIMINVYATAGDLHETDKIFQAMQRQGCLPDSFTYLSLIQGYTRNRNYHKAEETLYAMQRKGIPPSCVHFNILLHAFSKAGLIEEARRVYEGLSTFGLVPDLVCYRTMVNGYLKCGYVDEGTKLFESIRESTKGDRFIMSAAVHFYKSAGKESKAKEILISMNNKGIPFLRNLEVGSEERVKTP

SEQ ID NO: 14261 - protein, 602 aa, Glycine max
MDALRVAPTTPPLLRRHPLRKMAPHPLTARPRRAPLIVATLSMPPEATHSSAVAIVEDPSEAAPPPRPRVSPDSLQYPPGFVGAIPASSRSDGGDGDGMNNAMTYLTNILSSKVYDVAIESPLQLAPKLSARLGVKVWLKREDLQPVFSFKLRGAYNMMAKLPTELLEKGVICSSAGNHAQGVALAAKRLNCSAVIAMPVTTPEIKWKSVEALGATVVLVGDSYDEAQAYAKKRGVEEGRTFIPPFDHPDVIMGQGTIGMEIVRQMQGPIYAIFVPVGGGGLIAGIAAYVKRVNPEVKIFGVEPTDANAMALSLHHDQRVILDQVGGFADGVAVKEVGEETFRICKELIDGIVLVSRDSICASIKDMFEEKRNILEPAGALALAGAEAYCKHHGIQGKNIVAITSGANMNFDKLRVVTELANVGRKQEAVLATVMAEEPGSFKQFCELVGQMNITEFKYRYNSNEKAVVLYSVGVHTISELRAMQERMESSQLKTYNLTESDLVKDHLRYLMGGRSNVQNEVLCRLTFPERPGALMKFLDSFSPRWNISLFHYRGEGETGANVLVGLQVPKSEIDEFHDRANKLGYDYKVVNNDDDFQLLMH

SEQ ID NO: 14262 - protein, 601 aa, Cajanus cajan
MDALRVTPTPAPLLRRHHSREMARCPVPPRPRIKPFVAAKLSKPPEAAHSSTASAVVVEDLSAVAPPRPRVSPESLQYPPGYVGAIPSRSGSETSEGVMGAMTYLTNILSSKVYDVAIESPLQLAPKLSDRLGVNVWLKREDLQPVFSFKLRGAYNMMAKLPSETLEKGVICSSAGNHAQGVALSAKRLNCSAVIAMPVTTPEIKWKSVEALGATVVLVGDSYDEAQAYAKKRGLEEGRTFIPPFDHPDVIMGQGTVGMEIVRQMPNELFAIFVPVGGGGLIAGIAAYVKRVSPEVKIIGVEPTDANAMALSLHHDQRVILDQVGGFADGVAVKEVGEETFRICKELIDGVVLVSRDSICASIKDMFEEKRNILEPAGALALAGAEAYCKYNGIQGKNIVVITSGANMNFDKLRVVTELANVGRKQEAVLATVMPEEPGSFKQFCQLVGKVNITEFKYRYNSNEKAVVLYSVGVHTVSELRAMQERMESCLLKTYNLTESDLVKDHLRYLMGGRSNVQNEVLCRFTFPERPGALMKFLDSFSPRWNISLFHYRGEGETGANVLVGIQVPKNDMDEFHGRANRLGYDYKVVNNDDDFQLLMH

SEQ ID NO: 14263 - protein, 601 aa, Phaseolus vulgaris
MDSLRVATTPPPLLRRQALYQMTRHPLAARPSPKPFIAATLSTPPEAAHSSSYAVVVEDAPTVAPPRLRVSPDALQYPPGYVGAVPNRSRPDSGGDGVMNAMNYLTNILTSKVYDVAIETPLQLAPKLSTRLGVKVWLKREDLQPVFSFKIRGAYNMMAKLPRELLEKGVICSSAGNHAQGVAFSAKRLNCSAVIVMPVTTPEIKWKSVEALGAKVVLVGDSYDEAQAYAKKQAVEEGRTFIPPFDHPDVIMGQGTVGMEIVRQMQGPLHAIFVPVGGGGLIAGIAAYVKRVNPEVRIIGVEPSDANAMALSFHHDQRVILDQVGGFADGVAVKEVGEETFRICKELVDGVVLVSRDSICASIKDMFEEKRNILEPAGALALAGAEAYCKYNGIRGENIVVITSGANMNFDKLRVVTELANVGRKQEAVLATIMPEEPGSFKQFCQLVGQVNITEFKYRYNSDRKAVVLYSVGVHTVSELRAMQERMESSQLKTYNLTESDLVKDHLRYLMGGRSNIQNEVLCRFTFPERPGALMKFLDPFSPRWNISLFHYRGEGETGANILVGIQVPKSEMDEFHDRANRLGYDYQVVNNDDDFQLLMH

SEQ ID NO: 14264 - protein, 600 aa, Phaseolus vulgaris
MDSLRVATTPPPLLRRQALYQMTRHPLAARPSPKPFIAATLSTPPEAAHSSSYAVVVEDAPTVAPPRLRVSPDALQYPPGYVGAVPNRSRPDSGGDGVMNAMNYLTNILTSKVYDVAIETPLQLAPKLSTRLGVKVWLKREDLQPVFSFKIRGAYNMMAKLPRELLEKGVICSSAGNHAQGVAFSAKRLNCSAVIVMPVTTPEIKWKSVEALGAKVVLVGDSYDEAQAYAKKQAVEEGRTFIPPFDHPDVIMGQGTVGMEIVRQMQGPLHAIFVPVGGGGLIAGIAAYVKRVNPEVRIIGVEPSDANAMALSFHHDQRVILDQVGGFADGVAVKEVGEETFRICKELVDGVVLVSRDSICASIKDMFEEKRNILEPAGALALAGAEAYCKYNGIRGENIVVITSGANMNFDKLRVVTELANVGRKQEAVWPLRPGEPGSFKQFCQLVGQVNITEFKYRYNSDRKAVVLYSVGVHTVSELRAMQERMESSQLKTYNLTESDLVKDHLRYLMGGRSNIQNEVLCRFTFPERPGALMKFLDPFSPRWNISLFHYRGEGETGANILVGIQVPKSEMDEFHDRANRLGYDYQVVNNDDDFQLLMH

SEQ ID NO: 14265 - protein, 582 aa, Lupinus angustifolius
MEALRFSPTNPLFRFNNAPPNAARLNPFIAASVSLPAEIAPISHSPLIPPRPIVKSNSLQYPPGYVGAVPDHSPSSGDDSAMRYLTNILSSKVYDVAIESPLQLAPKLSERLGVRIWLKREDLQPVFSFKLRGAYNMMAKLSKEQLEKGVICSSAGNHAQGVALSAKRLNCSAVIAMPVTTPDIKWKSVENLGATVVLIGDSYDEAQAYAKKRAIEDGRTFVPPFDHPDVIIGQGTVGMEIVRQMQGPLHAIFVPVGGGGLIAGIAAYVKRVSPQVKIFGVEPTDANAMALSFHHGERVILDQVGGFADGVAVKEVGEETFRICKELVDGVVLVSRDSICASIKDMFEEKRSILEPAGALALAGAEAYCKYYGLKGGNVVAITSGANMNFDKLRIVTELANVGRKQEALLATILPEEPGSFKHFCQLVGQMNITEFKYRYNSKDKAVVLYSVGVHTVSELKAMQEKMESCQLETVNLTESDLVKDHLRYLMGGRSNLQNEVLCHFTFPERPGALVKFLDSFSPRWNISLFHYRGQGATGANVLVGIQVPQSEMDEFRDRATKLGYDYTVVNNDNVFQLLMHR

SEQ ID NO: 14266 - protein, 338 aa, Glycine max
MAGNSATATATSSALSPENLKFNFSPDNPSRIILTSDQVNHCTQALNLLKEKLHDPHVITQEFAHLQANRITPSEMRRRCTVAYDAVNLSKNRYTDVLPFNKNRVVLKSSTDYRPEAQGYINASLISTSSAGNVSHFIATQGPLPHTCEDFWEMITQYHCPVIIMLTRLVDNYKMVKCVDYFQAEDGPREVGNISIIGKWENTTETSLVLRHLEVNHREVDDAPLSVLHIQYPEWPDHGVPKDTLAVREILKRLYHLPSNLGPIVVHCSAGIGRTGAYCTIHNTIQRILAGDMSAVRIANTIAMFRSQRIGMVQTQDQYIFCYNAIIDELEDLVSQQQ

SEQ ID NO: 14267 - protein, 331 aa, Cajanus cajan
MAGNPTTTASSALSPEKFNFSPDYPSKIPLTSDQLKHCTQALNLLKDKFHTPHKITEEFAHLQGNRITPSEMRRRCTVALDAVNLSKNRYTDVLPFDNNRVVLKSSTDYRHAALGYINASLVSTPGNVSQFIATQGPLPHTYEDFWEMIIQYHCPAIIMLTRLVDHYRTVKCGDYFQAEDGPREVGNISIVGKWMSTTETSLVLRHLVVNHREVEEAALSVLHIQYPEWPDHGVPKDTFAVREILKRLYHLPPNLGPIVVHCSAGIGRTGTYCTIHNTIQRILAGDMSAVDIANTIAVFRSQRIGMVQTKDQYEFCYKAIIDELEDLVSQQ

SEQ ID NO: 14268 - protein, 331 aa, Cicer arietinum
MAGNPATPSSTFSRENLNLSSDFPTRISLTSDQVKHCTEALALLKDKRRNPHTISQEFLHLQANRITPSEMTRRCSVALNSVNISKNRYTDVLPFDKNRVVLNSSSDYRSAALGYINASFISTSSPGTVSEFLATQGPLPHTYEDFWEMIIQYHCPAIVMLTRLVDNYKMKCGDYFQAEDRPRELGNISLTCKWAKTTETSLVLRHFEVNHREVENAPLSVLHIQYPEWPDHGVPNDTLAVREILKRLYHLPPNLGPIVVHCSAGIGRTGTYCTIHNTIQRILAGDMSAVDIANTISVFRSQRIGMVQTQDQYIFCYQAIIDELEDLVSQQ

SEQ ID NO: 14269 - protein, 341 aa, Arachis hypogaea
MAASSAGNPPTSSLSSSAALSREKLNFSADYPARIALSSDQLKHCTEALSFFKEKLHTPQRIAQEFARLQANRITPSEMRRRCTVALDAVNLNKNRYTDVLPFDNNRVVLKSSTDYRPEAQGYINASCISASLPGNVSQFIATQGPLPHTYEDFWEMVIQYHCPAIVMLTKLVDNYKTIKCGDYFQAEDGPRECGNISIISKWIKSTETSLVLRHLEVNHKEAEDTPLSVLHIQYPEWPDHGVPRDTSAVREIFRRLHHLPANLGPIVVHCSAGIGRTGTYCTIHNTIQRILAGDMSALDISSTIAMFRSQRIGMVQTQDQFVFCYEAIIDELEDLVSLQK

SEQ ID NO: 14270 - protein, 509 aa, Glycine max
MKNPRKKKRPKPAQKKVLEENNKGVVVAGNENEEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSEGYLSDNPWPFGRKYVEVLNSSKADSAISPGCTKSEIPQKVLESLFNIPKSTEHDKDTMNWRNVVKKIQSLGPGFNVSPHVAESQQHTCAKGDEYHVFREDSKQQWDSVKSYYTKAATAYTKRERAYAAYLSDQGKEQTRLAQKADTKASHDIFIARNKGIENMITIDLHGQHVKQAMRMLKLHLLFGSYVPSVQTLRVITGCGSHGVGKSKLKQSVINLLDREAIEWREENQGTVLIKLSGWREYSFLDTSSDSDSND

SEQ ID NO: 14271 - protein, 376 aa, Glycine max
MYLSEKPRPIDFYKEEGARDMMIEVVSNGDLPPPPPPPPPPMILGESSGEDPEVEIKAPKKRAETWVQDETRSLIGLRREMDSLFNTSKSNKHLWEQISAKMREKGFDRSPTMCTDKWRNLLKEFKKAKHQDRGSGSAKMSYYKEIDEILRERSKNVQYKSPTPPPKVDSFMQFADKGIDDTSISFGPVEATGRPTLNLERSLDHDGHPLAITTADAVAASGVPPWNWRETPGNGGESQSCCGRVISVKWGDYTRRIGIDGTPEAIKEAIRAAFRLRTKRTFWLEDEDQIIRSIDREMPLGNYTLHIDEGMAIKLPLYDEPDHIPVHTEDKIFYTEDDFRDFLTRRGWICLREFDSYRNIDNMDDLRPGAIYRGVS

SEQ ID NO: 14272 - protein, 379 aa, Cajanus cajan
MYLSEKPRPIDFYKEEGARDMMIEVVSNGDLPPPPPLHPAPPPMILGESSGEDPEVEIKAPKKRAETWVQDETRSLIGLRREMDALFNTSKSNKHLWEQISAKMREKGFDRSPTMCTDKWRNLLKEFKKAKHQDRAGSGSAKMSYYKEIDEILRERSKSVQYKSPTPPPKVDSFMQFADKGIDDTSISFGPVEATGRPTLNLERSLDHDGHPLAITTADAVAASGVPPWNWREAPGNGGESQSCCGRVISVKWGDYTRRIGIDGTPEAIKEAIRAAFRLRTKRTFWLEDEDQIIRSIDREMPIGNYTLHLDEGMAIKLCLYDESDHIPVHTEDKIFYTEDDYRDFLTRRGWICLREFDGYRNIDNMDDLRPGAMYRGMS

SEQ ID NO: 14273 - protein, 377 aa, Phaseolus vulgaris
MYLSEKPRPIDFYKEEGARDMMIEVVSNGDLAPPPPHHPPPMILGESSGEDPEVEIKAPKKRAETWVQDETRSLIGLRREMDALFNTSKSNKHLWEQISAKMREKGFDRSPTMCTDKWRNLLKEFKKAKHQDRGGSGSAKMSYYKEIDEILRERSKNVQYKSPTPPPKVDSFMQFADKGIDDTSISFGPVEATGRPTLNLERSLDHDGHPLAITTADAVAASGVPPWNWRETSGNGGESQSCCGRVISVKWGDYTRRIGIDGTPEAIKEAIRAAFRLRTKRTFWLEDEDQIIRSIDREMPIGSYTLHLDEGMAIKLCLYDESEHLPVHTEDKVFYTENDYRDFLTRRGWVCLREFDGYRNIDNLDDLRPGAIYRGVS

SEQ ID NO: 14274 - protein, 378 aa, Lotus japonicus
MYLSEKPRPIDFYKQEGTRDMMIEVVSNAELPPPQHHQPPPMILGESSGEDPELEIKAPKKRAETWIQDETRSLIGLRREMDALFNTSKSNKHLWEQISAKMREKGFDRSPTMCTDKWRNLLKEFKKAKHHDRGGSGSAKMSYYKEIDEILRERSKCVQYKSHTPPSKVDSFMQFADKGIDDTSISFGPVEAAGRPTLNLERSLDHDGHPLAITAAEAVVASGVPPWNWRETETPGNGGESQSCGRVISVKWCDYTRRIGIDGTPEAIKEAIRAAFRLRTRRAFWLEDEDQIIRSIDRDMPIGNYTLHLDEGMAIKVCLYDEPDHIAVHTEEKIFYTEDDYRDFLTRRGWTCLREFDGYRNIDNMDDLRPGAIYRGVS

SEQ ID NO: 14275 - protein, 382 aa, Cicer arietinum
MYLSSEKPRPIDFYKEEARDMMMEVVTSSDLPPPPPPHHHQPQPQMILNAESSGEDPEMEIKAPKKRAETWVQDETRSLIGLRREMDSLFNTSKSNKHLWEQISAKMREKGFDRSPTMCTDKWRNLLKEFKKAKHQDRGGSGSAKMSCYKEIDEILRERNKCTQQYKSPTPTSKVESYMQFSDKGIDDANISFGPVEASGRPTLNLERGLDHDGHPLAIAADAVAASGVPPWNWRETPGNGGESQSCCGRVISVKWGDYTRRIGIDGTPEAIKEAIRAAFRLRTKRAFWLEDEEQIIRSIDREMPIGNYTLHLDEGMAIKVCLYDESDHIPVHTEDKIFYTEDDYRDFLARRAWTCLREFDGYRNIDNMDDLRPGAIYRGVS

SEQ ID NO: 14276 - protein, 385 aa, Trigonella foenum-graecum
MYLSSEKPRPIDFYKEEARDMMMEVVTNTDLQPPPPPHHHLQQPPPPQMILTAESSGEDPEMEIKAPKKRAETWVQDETRSLIGLRREMDSLFNTSKSNKHLWEQISAKMREKGFDRSPTMCTDKWRNLLKEFKKAKHHDRGGSGSGKMSCYKEIDEILRERSKCGQYKTVVTPTSKVESSYMHFDKGIDDANISFGPVEASGRPTLNLESSLDRDGHPLAIAAADVAASGVPPWNWRETPGNGGESQSCCGRVISVKWGDYTRRIGIDGTPEAIKEAIRAAFRLRTKRAFWLEDEEQIIRSIDRDMPIGNYTLHLDEGMAIKVCLYDESDHIPVHTEEKIFYTEDDYRDFLARRAWTSLREFDGYRNIDNMDDLRPGAIYRGVS

SEQ ID NO: 14277 - protein, 394 aa, Arachis hypogaea
MYLSEKPRPIDFYKEESSTRDMIIEVVSNGAADLPPPPSHQQQQMILGDSSGGEDPEVEIKAPKKRAETWVHEETRTLIALRREMDALFNTSKSNKHLWEQISSKMRDKGFDRSPTMCTDKWRNLLKEFKKAKHNDGAAGGGGGGGSGSAKMSYYKEIEEILRDRSKCVQYKSPTPPPPPPSNHKVESFMQFTDKGIEDTSISFGPVEATGRPTLNLERRLDHDGHPLAITTAEAVAASGVPPWNWRETPGNGEEGQSCCGRVISVKWGDYTRRIGIDGASEAIKEAIRAAFRLRTKRAFWLEDEDQIIRSLDRDMPLGNYTLHLDEGMAIKVCLYDESDHIPVHTEEKIFYTEDDYRDFLTRRGWTSLREFDGYRNIDNMDDLRPGAIYRGVT

SEQ ID NO: 14278 - protein, 380 aa, Prunus persica
MYLSEKPRAIDFYKEEGSRDMMIEVVSNDDLSQSQTHHPNHQPQQQQQQMLLGESSGEDHEVKAPKKRAETWVQDETRSLIALRREMDGLFNTSKSNKHLWEQISAKMREKGFDRSPTMCTDKWRNLLKEFKKAKHHDRGSGSAKMSYYKEIEEILKERNKNAQYKSPTPPKVDSFMQFSDKGIEDASISFAPVEASGRPTLNLERRLDHDGHPLAITAADAVTASGVPPWNWRETPGNGGEGQSCGRVILVTWGDYTRRIGIDGTADAIKEAIKSAFRLRTKRAFWLEDEDQIVRSLDRDMPLGNYTLHLDEGVAIKLCLYDESDHIPVHTEEKIFYTEDDYRDFLTRRGWSCLREFDGYRNIENMDDLRPGAIYRGVS

SEQ ID NO: 14279 - protein, 385 aa, Lupinus angustifolius
MYSLEKPRPIDFYKEEEETPEMMIEVVPTTDNNNNHHLQQPPPPPPPLMLTESSGDDPELDQIKAPKKRAETWVQDETRNLISLRREMDALFNTSKSNKHLWDQISAKMRDKGFDRSPTMCTDKWRNLLKEFKKAKHQDNRGSSKMSYYKEIDEILRERSCKSVHYKTPIPPTLSKVDSFMHFADKGIEDTSISFGPVEANGRPTLNLERSLDHDGHPLAITTADAVAASGVPPWNWRETPDNGGESQSCCGRVISVKWGDYTRRIGIDGTAEAIKEAIRSAFRLRTRRAFWLEDEEQIIRSIDRDMPLGNYTLHLDEGMAVKVCLYDESDHISVHTEEKIFYTEDDYRDFLTRRGWTCLREFDGYRNIDNMDDLRPGAIYRGVS

SEQ ID NO: 14280 - protein, 390 aa, Medicago truncatula
MYLSSEKPRPIDFYKEEARDMMMEVVTNTDLQPPPPPPSQHHHHLQQQQPQMILTAESSGDDPEMEIKAPKKRAETWVQDETRSLIGLRREMDSLFNTSKSNKHLWEQISAKMREKGFDRSPTMCTDKWRNLLKEFKKAKHHDRGGGSGSGGKMSCYKEIDEILRERSKCGQYKNVVTPTSKVESSYMQFDKGIDDANISFGPVEASGRPTLNLERSLDHDGHPLAIAAADVAASGVPPWNWRETPGNGGESQSCCGRVISVKWGDYTRRIGIDGTPEAIKEAIRAAFRLRTKRAFWLEDEEQIIRSIDRDMPIGNYTLHLDEGMAIKVCLYDESDHIPVHTEEKIFYTEDDYRDFLARRAWTGLREFDGYRNIDNMDDLRPGAIYRGVS

SEQ ID NO: 14281 - protein, 380 aa, Prunus mume
MYLSEKPRAIDFYKEEGSRDMMIEVVSNDDLSQSQTHHPNHQPQQQQQQMLLGDSSGEDHEVKAPKKRAETWVQDETRSLIALRREMDGLFNTSKSNKHLWEQISAKMREKGFDRSPTMCTDKWRNLLKEFKKAKHHDRGSGSAKMSYYKEIEEILKERNKNAQYKSPTPPKVDSFMQFSDKGIEDASISFAPVEASGRPTLNLERRLDHDGHPLAITAADAVTASGVPPWNWRETPGNGGEGQSCGRVILVTWGDYTRRIGIDGTADAIKEAIKSAFRLRTKRAFWLEDEDQIVRSLDRDMPLGNYTLHLDEGVAIKVCLYDESDHIPVHTEEKIFYTEDDYRDFLTRRGWSCLREFDGYRNIENMDDLRPGAIYRGVS

SEQ ID NO: 14282 - protein, 397 aa, Quercus alba
MYLSEKPRPIDFYKEEGARDMMIEVVSNGGGGGGDLPPHHAPQPHPHTHAHSHHQHQQMILGDSSGGDEDHEVEVEVKAPKKRAETWVQDETRSLISLRREMDGLFNTSKSNKHLWEQISSKMREKGFDRSPTMCTDKWRNLLKEFKKAKHQDRGSGSAKMSYYKEIEEILRDRSKNAQYKSPTPPKVDTYMQFSDKGIEDAGISFGPVEATGRPTLNLERRLDHDGHPLAITTADAVAASGVPPWNWRETPGNGGESQSYCGRVISVKWGDYTRRIGIDGSTDAIKEAIRCAFRLRTKRAFWLEDEDQIIRSLDRDMPLGNYMLHLDEGLAIKVCLYDESDHIPAMHTEDKIFYTEDDYRNFLSQRGWSCLRELDGYRNIDSMDDLRPGAIYRGVS

SEQ ID NO: 14283 - protein, 397 aa, Fagus grandifolia
MSIYLSEKPRPIDFYKEEGTRDMMIEVVSNGDLPPHHPQPHPHPHPHSHHHQQMILGDSSGGDEDHEVEVEVKAPKKRAETWVQDETRSLISLRREMDGLFNTSKSNKHLWEQISAKMREKGFDRSPTMCTDKWRNLLKEFKKAKHQDRGSGSAKMSYYKEIEEILRERSKNAQYKSPTPPKVDTYMQFSDKGIEDAGISFGPVEATGRPTLNLERRLDHDGHPLAITAADAVAASGVPPWNWRETPGNGGESQSYCGRVISVKWGDYTRRIGIDGSTDAIKEVIRCAFRLRTKRAFWLEDEDQIIRSLDRDMPLGNYVLHLDEGLAIKVCLYDESDHIPAMHTEDKIFYTEDDYRNFLSHRGWSCLRELDGYRNIDSMDDLRPGAIYRGVNYRGVN

SEQ ID NO: 14284 - protein, 390 aa, Manihot esculenta
MYLSEKPRPINFYKEEVPPATRDNMIIEVVSSNGDLPPHQHHLHNPHQQQPPQQQQQMILGESSGEDNHEVKAPKKRAETWVQDETRSLIALRREMDGLFNTSKSNKHLWEQISAKMREKGFDRSPTMCTDKWRNLLKEFKKAKHQDRGSGSAKMSYYKEIDEILRERSKNAQYKSPTPTKVDSYMQFADKGFDEASISFGPVEASGRSALNLERRLDHDGHPLAITAAEAVAASGVPPWNWRETPGNGAESQSFVGRVITVKYGDYTRRIGIDGTADAIKEAIKSAFRLRTKRAFWLEDEDQVIRSLDRDMPVGNYTLHLDEGLAVKVCLYDDSDHMPVHTEEKIFYTEDDYRDFLTRRGWSCLREFDGYRNIDNMDDLRPGAIYRGVS

SEQ ID NO: 14285 - protein, 381 aa, Theobroma cacao
MYLSEKPRPIDLYKEEGPTTARDMIIEVTTNVDLPPHHHPPPLQQQQQQMILGDSSGEDPEVKAPKKRAETWVQDETRSLIGFRREMDGLFNTSKSNKHLWEQISAKMREKGFDRSPTMCTDKWRNLLKEFKKAKHQDRGSGSAKMSYYKEIEEILRERTKNAYKSPTPPPKVDSFMHFADKGFEDTGISFGPVEASGRPTLNLERRLDHDGHPLAITATDAVAASGVPPWNWRETPGNGGDCQSYGGRVITVKFGDYTRRIGIDGTADAIREAIKSAFRLRTKRAFWLEDEDHIVRSLDREMPLGIYTLHVDEGLAIKVCLYDESDHIPVHTEEKIFYTEDDYREYLARRGYTGLRDIDGYRNVDNMDDLRTNVIYRGVS

SEQ ID NO: 14286 - protein, 385 aa, Populus trichocarpa
MYLSEKPRPLDFYKEEVGPSSSRDNMIIEVVSSNGDLPPLHLHPITAATNPHQMILGESSGDDNHEVKAPKKRAETWVQDETRSLIGFRREMDGLFNTSKSNKHLWEQISTKMRDKGFDRSPTMCTDKWRNLLKEFKKAKHQDRGSGSAKMSYYKEIDEILRGRNKNSQYKCPTPKVDSYMQFSDKGFEDTSISFGPVEASARPTLNLERRLDHDGHPLAITAADAVAASGVPPWNWRETPGNGAESQSFGGRVISVKSGDYTRRIGIDGTTDAIREAIKSAFRLRTKRAFWLEDEDQIIRALDRDMPLGNYTLHLDEGLAIKVCLYDQSDHIPMHTEEKIFYTEDDYRDFLSRRGWTCLREFDGYRNIDSMDDLRHDAIYRGVS

SEQ ID NO: 14287 - protein, 370 aa, Vitis vinifera
MYLPEKPRPLDFYKEEEEGRDMMIEVVSNGGLPHQQQQMILGDSSGEDHEPKAPKKRAETWVQDETRSLIAFRRDMDCLFNTSKSNKHLWEQISAKMREKGFDRSPTMCTDKWRNLLKEFKKAKHQDRGSGSAKMSYYKEIEEILKERSKNAHYKSPTMSKVDPFIQFSDKGIDDTSIPFGPVEASGRPTLNLERQLDHDGHPLAITSADAVTANGVPPWNWRETPGSGGESQSYGGRVISVKWGDYTRRIGIDGTADAIKEAIKSAFRLRTKRGFWLEDEDQIIRTLDRDMPLGSYSLHLDEGIGIKVCHYDESEHIPVHTEEKTFYTEEDFRDFLTRRGWSSLRELNGYRNIDNMDDLRPDSLYRGMS

SEQ ID NO: 14288 - protein, 399 aa, Manihot esculenta
MYLSEKPRPIDFYKEEVLPTTRDNMIIEVVSSSGDLPPHQHHLHNPHNPHPQQPPQQQQQQQQQQIILGESSGEDTHEVKAPKKRAETWVQDETRSLIGLRREMDGLFNTSKSNKHLWEQISAKMREKGFDRSPTMCTDKWRNLLKEFKKAKHQDRGSGSAKMSYYKEIDEILRDRSKNAQYKSPTPTSKVDSYMQFADKGFDDTSISFGPVEASGRPTLNLERRLDHDGHPLAITAAEAVAASAVPPWNWRETPGNGAESQSFVGRVITVKYGDYTRRIGIDGTADAIKEAIKSAFRLRTKRAFWLEDEDEIIRSLDRDMPVGNYTLHLDEGLSVKVCLYDESDHIPVHTEEKTFYSEDDYRDFLTRRGWSCLREFDGYRNIDNMDDLRPGAIYRGAS

SEQ ID NO: 14289 - protein, 384 aa, Populus trichocarpa
MYSSEKPRPLDFYKEEVTPSSRDNMIIEVVSSNGDLPPHHLPTTTNTNPHQMILGDSSGDDNHEVKAPKKRAETWVQDETRSLIGLRREMDGLFNTSKSNKHLWEQISAKMREKGFDRSPTMCTDKWRNLLKEFKKAKHKDRGSGSAKMSYYKEIDEILRERNKNPQYKSPIPSKVDSYMQFADKGFEDTSISFGPVEASPRPTLNLERRLDHDGHPLAITAADAVAASGVPAWNWRETPGNGAENQSYGGRVISVKYGDYTRRIGVDGTADAIKEAIKSAFRLRSKRAFWLEDEDQIIRSLDRDMPPGNYTLHLDEGLAIKVCLYDESEHMPVHTEEKIFYTEDDYREFLSRRGWTCLREFDGYRSIDSMDDLRHDAIYRGVS

SEQ ID NO: 14290 - protein, 409 aa, Gossypium hirsutum
QTPQTFYSTLSSSSDSKQPCTYRRNPVLLTYTKRKVRCCPRDMIIEVTSNGDLPPHHHHHHPPPPHHHHQHQQQQQQMILGESSGEDPEVKAPKKRAETWVQDETRSLIGFRREMDGLFNTSKSNKHLWEQISAKMREKGFDRSPTMCTDKWRNLLKEFKKAKHQDRGSGSAKMSYYKEIEEILRERTKNAYKSPTPPPKPDSFMHFADKGFEDAGISFGPVEASGRPTLNLERRLDHDGHPLAITAADAVAASGVPPWNWRETPGNGGDCQSYGGRVITVKYGDYTRRIGIDGTADAIREAIKSAFGLRSKRSFWLEDEDNIVRSFDREMPLGNYTLHLDEGLAIKVCLYDESDHIPVHTEDKIFYTEDDYREYLARRGYTGLRDIDGYRSVDNMDDLRPNAIYRGVS

SEQ ID NO: 14291 - protein, 393 aa, Gossypium raimondii
MYLSEKPRPIDLYKEEGPAAAPRDMIIEVTSNGDLPPHHHHHHPPPPHHHHQHQQQQQQQQMILGESSGEDPEVKAPKKRAETWVQDETRSLIGFRREMDGLFNTSKSNKHLWEQISAKMREKGFDRSPTMCTDKWRNLLKEFKKAKHQDRGSGSAKMSYYKEIEEILRERTKNSYKSPTPPPKPDSFMHFADKGFEDAGISFGPVEASGRPTLNLERRLDHDGHPLAITAADAVAASGVPPWNWRETPGNGGDCQSYGGRVITVKYGDYTRRIGIDGTADAIREAIKSAFGLRTKRSFWLEDEDNIVRSFDREMPLGNYTLHLDEGLAIKVCLYDESDHIPVHTEDKIFYTEDDYREYLARRGYTGLRDIDGYRSIDNMDDLRPNAIYRGVS

SEQ ID NO: 14292 - protein, 393 aa, Gossypium raimondii
MYLSEKPRPIDLYKEEGPAAAPRDMIIEVTSNGDLPPHHHHHHPPPPHHHHQHQQQQQQQQMILGESSGEDPEVKAPKKRAETWVQDETRSLIGFRREMDGLFNTSKSNKHLWEQISAKMREKGFDRSPTMCTDKWRNLLKEFKKAKHQDRGSGSAKMSYYKEIEEILRERTKNAYKSPTPPPKPDSFMHFADKGFEDAGISFGPVEASGRPTLNLERRLDHDGHPLAITAADAVAASGVPPWNWRETPGNGGDCQSYGGRVITVKYGDYTRRIGIDGTADAIREAIKSAFGLRSKRSFWLEDEDNIVRSFDREMPLGNYTLHLDEGLAIKVCLYDESDHIPVHTEDKIFYTEDDYREYLARRGYTGLRDIDGYRSIDNMDDLRPNAIYRGVS

SEQ ID NO: 14293 - protein, 382 aa, Citrullus lanatus
MYLSDKPRPIDIYKEEGSRDMMIEVASNGDHHIQPHQPQPQPQQTHQQHQMMLGDSSGEDHEVKAPKKRAETWVQDETRSLIALRREMDGLFNTSKSNKHLWEQISAKMRERGFDRSPTMCTDKWRNLLKEFKKAKHHDRGSGSAKMSCYKEIEEILKERSKSTQYKSPTPPKIDSYMQFSDKGIEDNGLSFGPVEAGGRPSLNLERQLDHDGHPLAITAADAVAATGIPPWNWREASGNGGESQAFGGRVISVKWGDYTRRIGVDGTSEAIKEAIKSAFRLRTKRAFWLEDEDQVVRSLDRDMPLGNYTLHLDEGVAVKICLYDESDHLPVHTEDKVFYIEEDYRDFLARRGWTCLREFDGYRNIDNMDDLRPGAIYRGIS

SEQ ID NO: 14294 - protein, 956 aa, Glycine max
MGKKNKVKENGGKEHCPSTLFVSNLPYSFSNSQLEETFSQVGPVRRCFMVTQKGSAQHRGFGYVQFAVEEDANRAIELKNGTSVEGRKIVVKHAMPRPPREERQSKPNQAGKTDDLTKPKDDDEDGRSSGSEKNVSVSKEEELQVSKQKSTRKPMEIKKSALCDDVADEGGCSEKQRVARTVIFGGLINSDMAEEVHSKAKEIGTVCSIKYPLSGKDLEQHGLLQDGCTLDASAVLYTSVKSARASVATLHKKEIGGGNVWARQLGGEGSKTQKWKLIIRNLPFKAKDNEIRDMFSSAGYVWDVFIPQKPDTGLSKGFAFVKFTCKQDAEKAIQKLNGSKFAKRLIAVDWAVSKKIFSSDTNNALASEKGQKNLSDEDSTDDDFELDDKRSGQGDDSDTDYSSAMEEEGTPEDNFDKEADIAKKVLNNLLTSSSKGTSANNDSMLIKENKESRSDEIVKDADEKNESGKVSGVSKPEISSRNNLSIPKRTEEDDLQGTVFICNLPFECDNEEVKQRFSGFGEVEYFVPVLHQVTKRPRGTGFLKFKTVEAANTAISTASAASGMGILLKGRPLKVLKALDKKSAHDKELEKAKNEVHDHRNLYLAKEGLILEGTTAAEGVSASDMLKRQELEKKKKTKLQSPNFHVSRTRLIIYNLPKSMNEKELKKLCIDAVISRATKQKPVIRQIKFLKNEKKGNVAQERYSRGVAFVEFSEHQHALVALRVLNNNPETFGPEHRPIVEFALDNVQTLKLRKAKLQSQLQAPQDDNNAMDNDKPGTVEGHKPVKNRKRKSQEHDKPAMESALNTNGELGVAVSNGKSPQGHKSKRQKGNNKSKKALKENPEALSMKPKNNENGQSNGGASLEGQNTATYSNRRKSGNREDWGFRKRKIQNQEQEAGQKVSKKRPKKNKDSVGKDVGDKLDMLIEQYRSKFSHKGSQENDGERKPSKQLRKWFQS

SEQ ID NO: 14295 - protein, 962 aa, Phaseolus vulgaris
MGKKNKVKDNGGKEHCSSTLFVSNLPYSFSNSQLEETFSEIGPVRRCFMVTQKGSAQHRGFGYVQFAVEEDANRAIELKNGVSVEGRKIGVKNAMPRPPREERKSKPNKVANVVAGTPDDLVKPKDDDVKDSISSGTEKHVSVLKEEAQVTSKQKSSKKPVETKKSALCKDAADDGGCSEKQRVARTVIFGGLIDSDMAEEVHNQAREIGTVCSVNYPLSRKDLDQHGLMQDGCTMDATSVLYTSVKSARASVAKLHKKVIRGETVWARQLGGEGSKTQKWKLIIRNLPFKAKDTEIRDMFSSAGYVWDVFIPQKSDTGLSKGFAFVKFTCKQDAENAIQKLNGSKFAKRVIAVDWAVPKKIFSSEMNDPRASEKGQQNLSDEDSDEEDVELVDKISGQGDDNDMNSPSAMEEEGAPPEDNFDEEADLARKVLNNLLGSSSKGTSENNDSMLSKEKKESRSDEDFKNADGKVSDDSEKVSGASNPEISSKNNLSNPNGTEEDLQRTVFITNLPFECDNEEVKQRFSGFGEVEYFAPVLHQVTKRPRGTGFLKFKTVEAANTAISTAIAASGTGILLQGRPLKVLKALDKKSAHDKELEKAKNEVHDHRNLYLAKEGLILEGSTAAEGVSASDMLKRQELERKKKTKLQSPNFHVSRTRLVVYNLPKSMHEKELKKLCIDAVISRATKQKPVIRQIKFLKNDKNGKVAQERYSRGVAFIEFSEHQHALVALRVLNNNPETFGPEHRPIVEFALDNVQTLKLRKAKLQQFQQQAPQDDNNAMRNDKPGNKEVHTPDRKRKAREHGEPAKETVLNTNGESEANGKSPQGQKFKRQKGNNKTKRALKENPEALSMKPKNNQNGQKSGGAAVEDQNTATATNRRKSGNKVDDDTGFRKRKMQNQEQEAGHKVVSKKRPKKNKNSVGKDVVDKLDMLIEQYRSKFSHKGSQENAEKKPSKQLRKWFQS

SEQ ID NO: 14296 - protein, 947 aa, Cajanus cajan
MGKKNKLKENGGKEHCASTLFVSNLPYTFTNSQLEETFSEVGPVRRCFMVTQKGSAQHRGFGYVQYAVEEDANRAIELKNGSSVGGRKIVVKHAMPRPPREERNSKPNQAALLYIYIYIYIFMYFFFSCLEVQVTNKQKNSGKPMETKKSALCNDVEDEGGCSEKQRVARTVIFGGLINSDMAEEVHRQAREIGTVCSIKYPLSRKDVEQHGLLQDGCTLDASAVLYTSVKSARASVAALHKKEIAGGSVWARQLGGEGSKTQKWKLIVRNIPFKAKDNEIRDIFSSAGYVWDVFIPHKSDTGLSKGFAFVKFTSKQDAENAIQKLNGSKFAKRLIAVDWAVPKKIFSSDTNNALDSEGQQKMSDDDSADEDVELVDKRSGQRDDSDTDYFIAMEEEAASPEDNFDMEADIARKVLNNLITSSSKGTSVNNDSVLSKENNEPRSDEIGEDAEGKASNESEKVSGFSKPEVSGRNYESNPKETEDDLQRTVFISNLPFECDNEEVKQRFSGFGEVEYFVPVLHQVTKRPRGTGFLKFKTVEAANTAISTASSASGMGILLKGRPLKILKALDKKSAHDKEVEKAKNEVHDHRNLYLAKEGLILEGTTAAEGVSASDMLKRQGLERKKKIKLQSPNFHVSRTRLVIYNLPKSMNEKGLKKLCIDAVISRATKQKPVIRQIKFLKDEKKGKVAQERHSRGVAFVEFSEHQHALVALRVLNNNPETFGSEHRPIVEFALDNVQTLKLRKAKQQFYQQGSQDDNNAMENDKPGTVEVRTSLNNGKRKSREQGEQVKDTALNTNGESGGTVANGRSPQGNKSKRHKGNNKSKRALKENPEASSMKPKNNQDGQNNGGASLEGKFTATDTNRRKSGNKDDGSFRKRKMQNQEQEPGQKFSKKRPKKNKDSVGKDVVDKLDILIEQYRSKFSHKGSQEKDGEKKPSKQLRKWFQS

SEQ ID NO: 14297 - protein, 79 aa, Glycine max
MSKVATLFTLALLLSFNLIHASRLNPSLKVFSSLREDVAATKEEINEESCEEGTEECLIRRTLAAHVDYIYTQKHKPKP

SEQ ID NO: 14298 - protein, 78 aa, Cajanus cajan
MSKVATLFTLLLLLSFNLIYASRPNPSHNTVSSLHVDVELKAEIDDESCEEDTEECLMRRTLAAHTDYIYTQKHKPKP

SEQ ID NO: 14299 - protein, 82 aa, Glycine max
MSKLATLLTLALLLSFNLIYASRPNPSLISVSSLHGDVAATKAEEIDGESCEEGTEECLARRTLAAHLDYIYTQKDKLGQHS

SEQ ID NO: 14300 - protein, 155 aa, Glycine max
MAAYREPMNMNMSDRAPVSPQQPHSPWHSPVPYLFGGLAAMLGLIAFALLILACSYWKLSGYLEGNGETERDLEAGETEQDQKPAKPYEEKILVIMAGQEKPTFLATPSVSSCSTSRSSSFGDNTSTCTCEENRKSLEMAQAGTGTTETAHSSSD

SEQ ID NO: 14301 - protein, 164 aa, Phaseolus vulgaris
MAAYREPMNVGDRAPVSSQQQPHSPWHSPVPYLFGGLAAMLGLIAFALLILACSYWKLSGYLEGNGETERDLEAGEGKTEQDQKPQRQYEEKILVIMAGQEKPTFLATPSVSSSSCSTSRSSSFGDNTSTCTCEETQKSLEMAQTAKEGSAESGTTETSSDQHP

SEQ ID NO: 14302 - protein, 164 aa, Vigna unguiculata
MAANREPMNVGARAPVSPQQPHSPWHSPVPYLFGGLAAMLGLIAFALLILACSYWKLSGYLEGNGETERDVEAGEGKTEQDQKPQRPYEEKILVIMAGQEKPTFLATPSVSSSSSCSTSRSSSFGDNTSTCTCEETRKSLEMAQTLKEGSAESGTTDTSSDQNP

SEQ ID NO: 14303 - protein, 309 aa, Glycine max
MKGEVQLQPPAVMQNPSDSDPLLHNQEEEDGSPGSSGEIKNEEEDVEAGLLPCCRICLESDSDPEDELISPCMCKGTQQFVHRSCLDHWRSVKEGFAFSHCTTCKAQFHLRVESFEDNSWRKIKFRLFVARDVFLVFLAVQTVIAAIGGFSYIMDKDGSFRNSFDDGWDRILSRHPIPFYYCIGVLAFFVLIGFFGLILHCSSLNSNDPRMAGCQNCCYGWGILDCFPASMEACFALVVVFVVIFAILGIAYGFLAATMAIQRIWQRHYHILTKRELTKEYIVEDLGGCYFPPKLDPEHEGRLKMLKLL

SEQ ID NO: 14304 - protein, 309 aa, Phaseolus vulgaris
MKGEVQLQPPPVMQNPSDSDPLLLNQEEDDESPGSSGEIKDDEEDVEAGLLPCCRICLESDSDPEDELISPCMCKGTQQFVHRSCLDHWRSVKEGFAFSHCTTCKAQFHLRVELFEDNSWRKIKFRLFVARDVFLVFLAVQTVIAAIGGFAYIMDKDGSFRNSFDDGWDKILSRHPIPFYYCIGVLAFFVLIGFFGLILHCSSLNTNDPRMAGCQNCCYGWGILDCFPASMEACFALVVVFVVIFAILGIAYGFLAATMAIQRIWQRHYHILTKRELTKEYIVEDLRGCYFPPKLDPEHEGRLKMLKLL

SEQ ID NO: 14305 - protein, 308 aa, Vigna unguiculata
MKGEVQLQPPPVMQNPSDSDPLLPNQEEEESPGSSGEIKDDEEDVEAGLLPCCRICLESDSDPEDELISPCMCKGTQQFVHRSCLDHWRSVKEGFAFSHCTTCKAQFHLRVELFEDNSWRKIKFRLFVARDVFLVFLAVQTVIAAIGGFAYIMDKDGSFRNSFDDGWDRILSKHPIPFYYCIGVLAFFVLIGFFGLILHCSSLNTNDPRMAGCQNCCYGWGILDCFPASMEACFALVVVFVVIFAILGIAYGFLAATMAIQRIWQRHYHILTKRELTKEYIVEDLRGCYFPPKLDPEHEGRLKMLKLL

SEQ ID NO: 14306 - protein, 307 aa, Cajanus cajan
MKGEVQLQPPPVLQNPSDTDPLLHDQEVDESPGSSGVIKDEEDIEAGSLPCCRICLESDSDPEDELISPCMCKGTQQFVHRSCLDHWRSVKEGFAFSHCTTCKAQFHLRVELFEDNSWRKIKFRLFVARDVFLVFLAVQTVIAAIGGFAYIMDKDGSFRNSFDDGWDRILSKHPIPFYYCIGVLAFFVLIGFFGLILHCSALNSNDPRMAGCQNCCYGWGILDCFPASMEACFALVVVFVVIFAILGIAYGFLAATMAIQRIWQRHYHILTKRELTKEYIVEDLRGCYFPPKLDPEHEGRLKMLKLL

SEQ ID NO: 14307 - protein, 307 aa, Lotus japonicus
MKGEVQLQPPPIMQNPSDSDPLLLDHDEDESPLSSAEIKDEEDVEAGSLPCCRICLESDSDPEDELISPCMCKGTQQFVHRSCLDHWRSVKEGFAFSHCTTCKAQFHLRVESYEDNSWRKIKFRLFVARDVFLVFVAVQTVIAAIGGFAYIMDKDGTFRNSFDDGWDRILSKHPIPFYYCIGVLAFFVLIGFFGLILHCSSLNSNDPRMAGCQNCCYGWGILDCFPASVEACFALVVVFVVIFAILGIAYGFLATTMAIQRIWQRHYHILTKRELTKEYIVEDLGGCYSPPKLDPEHEARLKMLKLL

SEQ ID NO: 14308 - protein, 306 aa, Arachis hypogaea
MKGEVQLQPPVVQQNLSDSEPLLENQEEDVSPVSSTEIKDEDLEAGSLPCCRICLESDSDPEDELISPCMCKGTQQFVHRSCLDHWRSVKEGFAFSHCTTCKAQYHLRVELFEDNSWRKAKFRLFVARDVFLVFLAVQTVIAGIGGFAYIMDKDGNFRNSFDDGWDRILSKHPIPFYYCIGVLAFFVLIGFFGLILHCTSLNSNDPRMAGCQNCCYGWGILDCFPASMEACFALVVVFVVIFAILGIAYGFLAATMAIQRIWQRHYHILTKRELTKEYVVEDLCGTYVPPKLDPEHEARLKMLKLL

SEQ ID NO: 14309 - protein, 312 aa, Medicago truncatula
MLGEVQLQPPPIQQNPSDSDPLLAHQDEVEDDDSHGSGNSNEIKDQEDIEAGSLPCCRICLESDSDPEDELISPCMCKGTQQFVHRSCLDHWRSVKEGFAFSHCTTCKAQFHLRVETYEDNSWRKIKFRLFVARDVFLVFLAVQTVIAAIGGFAYIMDKDGNFRNSFDDGWDRILSRHPIPFYYCIGVVAFFVLIGFFGLILHCSSLNSNDPRMAGCQNCCYGWGILDCFPASMEACFALVVVFVVIFAILGVAYGFLASTMAIQRIWQRHYHILTKRELTKEYIVEDLQGSYFPPKIDPEHESRLKMLKLL

SEQ ID NO: 14310 - protein, 310 aa, Cicer arietinum
MIGEVQLQPPPILQNPSDSDPLLDHQDDVQDESSPGSSTEIKDQEDVEAGLLPCCRICLETDSDFEDELISPCMCKGTQQFVHRSCLDHWRSVKEGFAFSHCSTCKAQFHLRVEMFEDNSWRQIKFRLFVARDVFLVFLAVQTVIAAIGGFAYIMDKDGNFRNSFDDGWDRILSKHPIPFYYCIGVVAFFVLIGFFGLILHCSSLNSNDPRMAGCQNCCYGWGILDCFPASMEACFALVVVFVVIFAILGVAYGFLASTMAIQRIWQRHYHILTKRELTKEYIVEDLQGCYFPPKLDPEHESRLKMLKLL

SEQ ID NO: 14311 - protein, 319 aa, Lupinus angustifolius
MDKIHHEGEVQLQPPQIVQNPSRDSDPLLENQEEEEEERESPAATSTEIKDEDEDVEAGLLPSCRICLESDSDPEDELISPCMCKGTQQFVHRSCLDHWRSVKEGFAFSHCTTCKAQFHLRVESFEDNSWRKVKFRLFVARDVFLVFVAVQTVIAAIGGFAYIMDKDGNFRNSFDDGWDRILSRHPIPFYYCIGVLSFFVLIGFFGLILHCSSLNNNDPRMAGCQNCCYGWGILDCFPASMEACFALVVVFVVIFAILGIAYGFLATTMAIQRIWQRHYHILTKRELTKEYIVEDLGGSYSPPKLDPEHEARLKMLNLL

SEQ ID NO: 14312 - protein, 300 aa, Trigonella foenum-graecum
SANPSDSDPLLAHQDEVEDDDSHGSGNSNEIKDHEDVEAGSLPCCRICLESDSDPEDELISPCMCKGTQQFVHRSCLDHWRSVKEGFAFSHCTTCKAQFHLRVETYEDNSWRKIKFRLFVARDVFLVFLAVQTVIAAIGGFAYIMDKDGNFRNSFDDGWDRILSKHPIPFYYCIGVVAFFVLIGFFGLILHCSSLNSNDPRMAGCQNCCYGWGILDCFPASMEACFALVVVFVVIFAILGVAYGFLASTMAIQRIWQRHYHILTKRELTKEYIVEDLQGSYFPPKLDPEHESRLKMLKLL

SEQ ID NO: 14313 - protein, 306 aa, Prunus mume
MKGEVQLEPAGERERDPTDVDPLLEDQEDSSPGSSTEIYNEDLESGSIPCCRICLESDAEPGDELISPCMCKGTQQFVHSSCLDHWRSVKEGFAFSHCTTCKAQFHLRVESYEDNSWRKIKFRVFVARDVFLVFLAVQSVIAAIGGFAYVMDKDGAFRNSFSDGWDRILSKHPIPFYYCIGVLAFFVLLGFFGLILHCSSLNSNDPRMAGCQNCCYGWGILDCFPASMEACFALVIVFVVIFAILGIAYGFLAATMAIQRIWQRHYHILTKRELTKEYIVEDLHGCYTPPKLDPEHEARLKMLKLL

SEQ ID NO: 14314 - protein, 306 aa, Prunus persica
MKGEVQLEPAGETERDPTDVDPLLENQEDSSPGSSTEIYNEDLESGSIPCCRICLETDAEPGDELISPCMCKGTQQFVHSSCLDHWRSVKEGFAFSHCTTCKAQFHLRVESYEDNSWRKIKFRVFVARDVFLVFLAVQSVIAAIGGFAYVMDKDGAFRNSFSDGWDRILSKHPIPFYYCIGVLAFFVLLGFFGLILHCSSLNSNDPRMAGCQNCCYGWGILDCFPASMEACFALVIVFVVIFAILGIAYGFLAATMAIQRIWQRHYHILTKRELTKEYIVEDLHGCYTPPKLDPEHEARLKMLKLL

SEQ ID NO: 14315 - protein, 304 aa, Vitis vinifera
MKGEVQLEPSGERNPRDSDPLLENQADSSTGSSSEINSEDIEAGSVPCCRICLECDGEPDDELISPCMCKGTQQFVHRSCLDHWRSVKEGFAFSHCTTCKAQYHLQVALFEDNSWRKIKFRLFVARDVFLVFLAVQTVIGAMGGFAYIMDKDGAFRNSFSDGWDRILSRHPIPFYYCIGVLAFFVLLGFFGLILHCSSLNSNDPHMAGCQNCCYGWGILDCFPASMEACFALVIVFVVIFAILGVAYGFLAATMAIQRIWQRHYHILTKRELTKEYIVEDLRGCYTPPKLDPEHEERLKMLKLL

SEQ ID NO: 14316 - protein, 154 aa, Carpinus betulus
MKGEVQLEPTGTAAGNPSDSDPLLENQADSPPGSSSEIKDEDIEAGTIPCCRICLESESEGEPEDELISPCMCKGTQQFVHRSCLDHWRSVREGFAFSHCTTCKAQFHLRLTVFEDNSWRKIKIQTFCGKGCLPCILSCTNCNCCNRWLCIRNG

SEQ ID NO: 14317 - protein, 305 aa, Unknown
  Sequence found in Organisms: Gossypium hirsutum, Gossypium raimondii
MSGELQLEPAGARNPSDSDPLLGNQIDSPSPASSSEIRSEDIENGSAPCCRICLECDGEEDDELISPCMCKGTQQFVHRACLDHWRSVKEGFAFSHCTTCKAQFHLRVELFEDNSWRKIKFRLFVARDVFLVFLAVQTVIAAMGGFAYVMDKDGAFRKSFSDGWDRILSNHPIPFYYCVGVLAFFVLLGFFGLILHCSSLNSNDPRMAGCQNCCYGWGILDCFPASMEACFALVVVFVVIFAILGIAYGFLAATMAIQRIWQKHYHILTKRELTKEYIVEDLHGSYTPPKLDPEHEERLKMMKLL

SEQ ID NO: 14318 - protein, 308 aa, Malus domestica
MKGEVQLEPTGEGERDRDPTDIEPLLPNQDDSSPASSSEINNEDLESGSIPCCRICLESDAEPEDELISPCMCKGTQQFVHRSCLDHWRSIKEGFAFSHCTTCKAQFHLRVETYEDNVWRKIKFRVFVARDVFLVFLAVQSVIAAIGGFAYVMDKDGAFRNSFSDGWDRILSKHPIPFYYCIGVLAFFVLLGFFGLILHCSSFNSNDPRMAGCQNCCYGWGILDCFPASMEACFAVVIVFVVIFAILGIAYGFLAATMAIQRIWQRHYHILTKRELTKEYIVEDLHGCYTPPKLDAEHEARLKMLKLL

SEQ ID NO: 14319 - protein, 305 aa, Momordica charantia
MKGEVQLDSSIGQNPSDSDPLLENQADSSSHGTSDEIKNEDTEAGSIPCCRICLESDAEPEDELISPCMCKGTQQFVHRSCLDHWRSVKEGFAFSHCTTCKAQFHLKVSLFEDNSWRKVKFRLFVARDVLLVFLAVQTLIAAMSGYAYIMDKDGTFRNSFSDGWDRILSKHPIPFYYCIGVLAFFVLLGFFGLILHCSSLNSNDPRVAGCHNCCYGWGILDCFPASMEACFALVIVFVVIFVILGIAYGFLAATMAIQRIWQRHYHILTKRELTKEYVVEDLHGCYTPPKLDPEHEQHLKMLRLL

SEQ ID NO: 14320 - protein, 311 aa, Castanea mollissima
MKGEVQLEVTSAGDPIPSDADPLLENHADSSSPGSSSSSSNEIRNEDIEAGSNSCCRICLESDAEPEDELISPCMCKGTQQFVHRSCLDHWRSVKEGFAFSHCTTCKAQYHLRVALFEDNSWRKLKFRIFVARDVFLVFLAVQTVIAAMGGFAYLMDKDGTFRNSFSDSWDRILSKHPIPFYYCIGVLAFFVLLGFFGLILHCSSLNSNDPRMAGCQNCCYGWGILDCFPASMEACFALVIVFVVIFAILGIAYGFLAATMAIQRIWQRHYHILTKRELTKEYIVEDLHGCYAPPKLDPEHEARLKMLKLL

SEQ ID NO: 14321 - protein, 697 aa, Theobroma cacao
MDNLRSPFTGVLHDFKGRKSCYKQDWAAGRCTGLRILAPTTYVFFASALPVIAFGAQLNRETDGSLSTVETLASTAICGIIHSIFGGQPLLILGVAEPTVIMYSYLYSFANGRDDLGKELFLAWAGWVCVWTAFLLVLLAIFNACTIINKFTRIAGELFGMLIAVLFIQQAIKGIVSEFEVPDAGNQNSEKDSFQWLYVNGLLGVIFTFGLLITALKSRGARSWRYGTGWCRSLIADYGVPLMVVAWSAMSFIVPGKVPSGVPRRLVSPLPWESASLEHWTVMKDMANVPPVHVFTAFLPAIMIAGLYFFDHTVASQLAQQKEFNLKKPSAYHYDIFILGIMTLICGLIGLPPSNGVLPQSPMHTKSLAVLKRQIIRKKMVKGAKECLKQKASKSIIYGRMQEIFEEMDSTSAVSTLVLCILGFLKIYHNDHPSAAQDLKDLKAAVFKAEDGGNTDCKFDPEKHIEAHLPVRVNEQRVTNLLQSILVGVSLLAMPIIKKIPTSVLWGYFAYMAIDSLPGNQFWERMLLLVIAPSRRYKVLEGAHASFVESVPFKNIAVFTLLQLVYLLMCFGVTWIPIAGILFPLPFFLLISIRQHILPKFFQPLHLHELDAAEYEEIPAGTYNHNHGILFKVRNLTAYITEQNHSGDEDSEVETDDQELFDELTTSRGELKLRSRSFREDKHGQVHQGEVDPENGM

SEQ ID NO: 14322 - protein, 305 aa, Theobroma cacao
MTGELQLEPAGARNPSDSDPLLQNQADSLSSASSSEIRSEDIENVSAPCCRICLECDGEEDDELISPCMCKGTQQFVHRSCLDHWRSVKEGFAFSHCTTCKAQFHLRVELFEDNSWRKIKFRLFVARDVFLVFLAVQTVIAAMGGFAYFMDKDGAFRKSFSDGWDRILSKHPIPFYYCIGVLAFFVLLGFFGLILHCSSLNSNDPRMAGCQNCCYGWGILDCFPASMEACFALVVVFVVIFAILGIAYGFLAATMAIQRIWQKHYHILTKRELTKEYIVEDLHGSYTQPKLDPEHEERLKVMKLL

SEQ ID NO: 14323 - protein, 305 aa, Cucumis melo
MKGEVQLESSIGQNPSDSDPLLENQNDSSSHGTSDEIKDEDTEAGSIPCCRICLESDAEPEDELISPCMCKGTQQFVHRSCLDHWRSVKEGFAFSHCTTCKAQFHLKVSLFEDNSWRKVKFRLFVARDVLLVFIAVQTLIAAIGGYAYIMDKDGAFRNSFSDGWDRILSKHPIPFYYCIGVLAFFVLLGFFGLILHCSSLNSNDPRVAGCHNCCYGWGILDCFPASMEACFALVIVFIVIFVILGIAYGFLAATMAIQRIWQRHYHILTKRELTKEYVVEDLHGCYTPPKLEPEHEQHLKMLQLL

SEQ ID NO: 14324 - protein, 312 aa, Carica papaya
MKGEVQLEPAVAESPSDSAPLLENQPDSLSSPLSGSPESSSEIRDEDVENGSAPCCRICLESDSEFVGDELISPCMCKGTQQFVHRSCLDHWRSVKEGFAFSHCTTCKAQFHLQVALFEDNSWQKAKFRIFVARDVLLVFLAVQTVIAAMGGFAYLMDKDGAFRNSFSDGWDRILSKHPIPFYYCIGVLAFFVLLGFFGLILHCSSLNGNDPRMAGCQNCCYGWGVLDCFPASMEACFALVIVFIVIFAILGIAYGFLAATMAIQRIWQRHYHILTKRELTKEYVVEDLHGCYTPPKLDPEHEGRLKMLKLL

SEQ ID NO: 14325 - protein, 305 aa, Citrullus lanatus
MKGEVQLESSIGQNPSDSDPLLENQTDSSSHGTSDEIKDEDTEAGSIPCCRICLESDAEPEDELISPCMCKGTQQFVHRSCLDHWRSVKEGFAFSHCTTCKAQFHLKVSLFEENSWRKVKFRLFVARDVLLVFIAVQTLIAAMGGYAYIMDKDGAFRNSFSDGWDRILSKHPIPFYYCIGVLAFFVLLGFFGLILHCSSLNSNDPRVAGCHNCCYGWGILDCFPASMEACFALVIVFVVIFVILGIAYGFLAATMAIQRIWQRHYHILTKRELTKEYVVEDLHGCYTPPKLEPEHEQHLKMLQLL

SEQ ID NO: 14326 - protein, 297 aa, Cucurbita pepo
MKGEVQLESSIGQTPSDSDPLLENQPDSSHETSDEIKNEDTEAGSIPCCRICLESDAEPEDELISPCMCKGTQQFVHRSCLDHWRSVKEGFAFSHCTTCKAQFHLQVSLFEDNSWRKVKFRLFVARDVLLVFLAVQTLIAAMGGYAYIMDKDGAFRNSFNDGWDRILSKHPIPFYYCIGVLAFFVLLGFFGLILHCSSLNSNDPRVAGCHNCCYGWGILDCFPASMEACFALVIVFVVIFVILGIAYGFLAATMGIQRIWQRHYHILTKRELTKEYVVEDLHGCYTPPNWNQNTNST

SEQ ID NO: 14327 - protein, 308 aa, Manihot esculenta
MIREVQLEPVGAENPSDSDPLLVDKADSSSPPPLSSSEINNEDDIENGSIPCCRICLESDCELGDELISPCMCKGTQQFVHRLCLDHWRSVKEGFAFSHCTTCKAQFHLRVALFEDNSWRKVKFRLFVTRDVIIVFLAVQTVIAAIGGFAYFMDKDGTFRNSFSDGWDRILSKHPIPFYYCIGVLAFFVLLGFFGLILHCSSLNSNDPGMAGCQNCCYGWGILDCFPASMEACFALVLVFVVIFAILGIAYGFLAATMAIQKIWQRHYHILTKRELTKEYIVEDLHGCYTPPKLDSEHEERLKMLKLL

SEQ ID NO: 14328 - protein, 311 aa, Quercus alba
MKGEVQLEVTSAENPSPSDADPLLDKHADSSSPRSSSSSSNEIRNEDIETGSNSCCRICLESDAEPEDELISPCMCKGTQQFVHRSCLDHWRSVKEGFAFSHCTTCKAQYHFCVALFEDNSWRKLKFRIFVARDVFLVFLAVQTVIAAMGGFAYLMDKDGAFRNSFSDSWDRILSKHPIPFYYCIGVLAFFVLLGFFGLILHCSSLNGNDPRMAGCQNCCYGWGILDCFPASMEACFALVIVFVVIFAILGIAYGFLAATMAIQRIWQRHYHILTKRELTKEYIVEDLHGCYAPPKLDPEHEARLKMLKLL

SEQ ID NO: 14329 - protein, 306 aa, Cucurbita pepo
MKGEVQLESSIAQKPTDSDPLLENQSDSSHGGTSDEIRDDEDAEAGSIPCCRICLESDAEPEDELISPCMCKGTQQFVHRSCLDHWRSIKEGFAFSHCTTCKAQFHLKVSLFEDNSWRKVKFRFFVARDVLLVFLAVQTLIAAIGGYAYIMDKDGAFRNSFSDGWDRILSKHPIPFYYCIGVLAFFVLLGFFGLILHCSSLNSNDPRVAGCHNCCYGWGILDCFPASMEACFALVIVFVVIFVILGIAYGFLAATMAIQRIWQRHYHILTKRELTKEYVVEDLHGCYTPPKLDPEHEQHLKMLQLL

SEQ ID NO: 14330 - protein, 315 aa, Fragaria vesca
MNREVQLEPVVVGEREPNDPSDLDPLLQSSHDDDDESSAPASSSEIRNEDIENGSSVACCRICLESDSDAGDELISPCLCKGTQQFVHISCLDHWRSVKEGFAFSHCTTCKAQFHLRVESYEDNTWRKMKFRIFVARDVILVFVAVQTVIAAIGGFAYLMDKDGGFRNSFSDGWDRILSKHPIPFYYCIGVIAFFVLLGFFGLIVHCSSFNSNDPRMAGCQNCCYGWGILDCFPASMEACFALVIVFVVIFAILGIAYGFLAATMAIQRIWQRHYHILTKKELTKEYVVEDLHGCYTPPKLDPEHEERLKMLKLL

SEQ ID NO: 14331 - protein, 317 aa, Catharanthus roseus
MKGEVQLESRVERNPRDSDPLLDEHRHCVEPPQPPLPFSSSSPTSTSEIEDEDLEAGSLPCCRICLECDGEDDDELISPCMCKGTQQFVHRSCLDHWRSVKEGFAFSHCTTCKAQFHLRVAELEDNYCRKIKFRLFVARDVFLVFLAVQTVIAVIAGFAYFMDKDGSFRTSFNDSWDRILSKHPIPFYYCIGVLGFFVLLGFFGLILHCSSLNNNDPRVAGCQNCCYGWGILDCFPASMEACFALVIVFVVIFAILGIAYGFLAATMAIQRIWQRHYHILTKRELTQEYIVEDLSGNYSPPKLDPEHEERLKMLKLL

SEQ ID NO: 14332 - protein, 303 aa, Panax ginseng
MTGELQLEPSGDRNPSDSDPLLDNHHGPASSSEIIKNDDADIEAGSVACCRICLECDGEDDDELISPCMCKGTQQFVHRMCLDHWRSVKEGFAFSHCTTCKAQFHFRVAELEDNSWRKIKFRLFVARDVFLVFLAVQTVIAVIAGFAYLLDKDGTFRNSFNDSWDRILSKHPIPFYYCIGVLGFFVLLGFFGLILHSLNSSDPRMAGCQNCCYGWGILDCFPASMEACFALVIVFVVIFAILGIAYGFLAATMAIQRIWQRHYHILTKRELTQEYVVEDLHGCYTPPKLDPEHEERLKMLKLL

SEQ ID NO: 14333 - protein, 314 aa, Euonymus alatus
MEGELQLEPLPAAGAIGAGDEGDRDESDPLLENQPDSPPGSSSEIKHEDDVEGGSIPCCRICLDYDGESDDELISPCLCKGTQQLVHRSCLDHWRSVKEGFAFSHCTTCKAQYHLRVELFEDNSWHKIKFRLFVARDVFLVFLAVQTIIAAIGGFAYAMDKDGTFRNSFSDGWDRILSKHPIPFYYCIGVLAFFMLLGFFGLILHCSSLNNNDPRMAGCQNCCYGWGILDCFPASMEACFALVIVFVVIFAILGIAYGFLAATMAVQRIWQRHYHILTKRELTKEYIVEDLHGCYTPPKLDAEHEERLKMLKLL

SEQ ID NO: 14334 - protein, 243 aa, Cucumis sativus
MCKGTQQFVHRSCLDHWRSVKANFFILEGFAFSHCTTCKAQFHLKVSLFEDNSWRKVKFRLFVARDVLLVFIAVQTLIAAIGGYAYIMDKDGAFRNSFSDGWDRILSKHPIPFYYCIGVLAFFVLLGFFGLILHCSSLNSNDPRVAGCHNCCYGWGILDCFPASMEACFALVIVFVVIFVILGIAYGFLAATMAIQRIWQRHYHILTKRELTKEYVVEDLHGCYTPPKLEPEHEQHLKMLQLL

SEQ ID NO: 14335 - protein, 311 aa, Eutrema halophilum
MQGEVQLQPPDSQKLSDSDPLLGNSPSSSSSASPSDEINAEDLESGSASAPCCRICLENDSELLGDELISPCMCKGTQQFVHRSCLDHWRSVKEGFAFSHCTTCKAQFHLRVEPFEDNNSWRRKAKFRLFVARDVLLVFVAVQTVIAVMAGFAYMMDKDGEFRNSFNDDWDRILSKHPIPFYYCIGVVTFFVLIGFLGLILHCSSLNGNDPRMAGCQNCCYGWGILDCFPASMEACFALVVVFVVIFAILGLAYGFLAATMAIQRIWQRHYHILTKRELTKEYIVEDLHGCYTPPKLDAEHEARLKLLKLM

SEQ ID NO: 14336 - protein, 77 aa, Panax ginseng
MIKTHAVHKLLGAFAHAGRDQFIIIFTVTFEANSTTSDGTSFNISISIIILYYLTRTGCMSMVIVKQRIGVARVSIT

SEQ ID NO: 14337 - protein, 304 aa, Platanus occidentalis
MTGEVQLEPSGERNPSDSDPLLENQANSLTGSSNEIKDEEIEAASAACCRICLEYDGEPDEDLISPCMCKGTQQFVHRSCLDHWRSVKEGFAFSHCTTCKAQFHLRVELLEDNSWRKVKFRIFVARDVLLVFLVVQTVIAAMGGFAYLMDKNGNFRNSFSDGWDRILSKHPIPFYYCIGVLAFFVLLGFFGLILHCSSFNNNDPCMAGCRNCCYGWGILDCFPASMEACFALVIIFVIIFAILGIAYGFLAATMAIQRIWQRHYHILTKRELTKEYVVEDLHGNYTPPKLDPEHEERLKSLKLM

SEQ ID NO: 14338 - protein, 312 aa, Unknown
  Sequence found in Organisms: Citrus clementina, Citrus sinensis
MKGDLQLEQFSERNPSDADPLLGSQEVSDAPVVSSPSSSSSSEIKDEDIENGSLPCCRICLENDGEPDDELISPCMCKGTQQFVHRACLDHWRSVKEGFAFSHCTTCKAQFHLRVELFEDNSWRKIKFRLFVARDVFFVFLAVQTIIAAMGGFAYLMDKDGAFRNSFSDGWDRILSKHPIPFYYCIGVMAFFVLLGFFGLILHCSSFNTNDPRMAGCQNCCYGWGVLDCFPASMEACFALVIVFVVIFAILGIAYGFLAATMAIQKIWQKHYHILTKKELTKEYVVEDLHGSYTPPKLDSEHEERLKMLKLL

SEQ ID NO: 14339 - protein, 325 aa, Eucalyptus grandis
MTTTTTGEVQLEPPGVQHASDTDPLLKGQDESAPGSPSEIRDDRDRVVFGGGGGGEGEDEDLEAGSVPCCRICLESECEPGDELISPCMCKGTQQFVHRCCLDHWRSVKEGFAFSHCTTCKAQFHLRVALFEDNTWRKVKFRLFVARDVFLVFLAVQTVISVIGGFAYIMDKDGSFRNSFSDGWDRILSKHPIPFYYCIGVLAFFVLLGFFGIILHCSSLNGNDPRMAGCQNCCYGWGILDCFPASMEACFALVIVFVVIFAILGIAYGFLAATMAIQRIWQRHYHILTKRELTKEYIVEDLRGCYYPPKLDAEHEERLRILKLL

SEQ ID NO: 14340 - protein, 138 aa, Tropaeolum majus
MKGEVQLEQAGVPNPSDSDPLLGNHPDSSSSSSLSSTPESCGEIGSEDLEIGSSAPCCRICLENDSEFDDELISPCMCKGTQQFVHRSCLDHWRSVKEGFAFSHCTTCKAQYHLQVASFEDNSWRKAKFRILWQGTWY

SEQ ID NO: 14341 - protein, 318 aa, Ricinus communis
MKGEVQLEALSADNPPSDSDPLLQNQAHSPSSSLPVPGRLSEIDNEEDDDDVDDIENASVPTCRICLESDCEPGDELISPCMCKGTQQFVHRSCLDHWRSVKEGFAFSHCTTCKAQFHLQVALFEDNSWRKMKFRIFVTRDVIIVFLVVQTVIAAMGGFAYLMDKDGAFRNSFSDGWDRILSKHPIPFYYCIGVLAFFVLLGFFGLILHCSSLNSNDPRMAGCQNCCYGWGILDCFPASMEACFALVLVFVVIFAILGIAYGFLAATVAIQKIWQRHYHILTKRELTKEYIVEDLHGCYTPAKLDSEHEERLKMLKLL

SEQ ID NO: 14342 - protein, 305 aa, Unknown
  Sequence found in Organisms: Gossypium hirsutum, Gossypium raimondii
MTGELQLESADERNLTDSDPLLENPVDSSSPVSSTEIRNEDIENVSAPCCRICLECDGEEDDELISPCMCKGTQQFVHRACLDHWRSVKEGFSFSHCTTCKARFHLRVELFEDNSWRKLKFRIFVARDVFLVFLAVQTVIAAIGGFAYVMDKDGAFRNSFSDGWDRMLSKHPIPFYYCIGVLAFFVLLGFFGLIVHCTSFNSNDARMAGCQNCCYGWGVLDCFPASMEACFALLVVFVVIFVILGIAYGLLAATMAIQRIWQKHYHILTKRELTKEYIVEDLHGSYTPPKLDPEHEERLKMMKLL

SEQ ID NO: 14343 - protein, 307 aa, Euphorbia peplus
QLETVRGEEEEGNHSDSDPLLQNQVDSSSAPPIISGEINSEEDLESGSIPSCRICLETDCEPGDELISPCMCKGTQQFVHRSCLDHWRSVKEGYAFSHCTTCKAQFHLRVELFEDNSWRRMKFRLFVTRDVVIVFLAVQTLIAAMGGFAYLMDKDGAFRNSFSDGWDRILSKHPIPFYYCIGVLAFFVLLGFFGLILHCSALNTNDPTMAGCQNCCYGWGILDCFPASMEACFALVLVFVVIFAILGIAYGFLAATMAIQKIWQRHYHILTKRELTKEYIVEDLHGCYTPPKLDPEHEERLKMLKLL

SEQ ID NO: 14344 - protein, 869 aa, Phaseolus vulgaris
MASCISLSLCPHTFCCRHRPYSTRRSLSCSLSSSSLLDTDGHKVLRKRSRRIEGPRKSMEDSVQRKMEEFYEGRDGPPLRVLPIGGLGEIGMNCMLVGNYDRYILIDAGIMFPDYDELGIQKIIPDTTFIRKWRHKIEAVIITHGHEDHIGALPWVIPALDSHTPIFASSFTMELIRKRLKDHGIFVPSRLKVFRTRKKFMAGPFEIEPITVTHSIPDCCGLVLRCSDGTILHTGDWKIDETPLDGKVFDREALEELSKEGVTLMMSDSTNVLSPGRTTSESIVADALLRNISAAKGRVITTQFASNIHRLGSVKAAADSSGRKLVFVGMSLRTYLDAAWKDGKAPIDPSTLVKAEDIDAYAPKDLLIVTTGSQAEPRAALNLASYGSSHSFKLTKEDIVLYSAKVIPGNESRVMEMLNRISDIGSTIIMGKNECLHTSGHAYRGELEEVLRIVKPQHFLPIHGELLFLKEHELLGKSTGIRHTTVIKNGEMLGVSHLRNKRVLSNGFISLGKENFQLMYSDGEKAFGTSSELFIDERMRIALDGIIVISMEIFRPQNLESPVENTLKGKIRITTRCLWLDKGKLLDALHKAAHAALSSCPASCPLAHMERIVSEVVRKMVRKYSGKRPEVIVIAVENPAAVLASEINMKLSGKFHMDGTSALKKVVVGRGKENQRTKTQIRERIDVGGILPTEDIAISSGVEDDLSDAENSDDFFKPLVGSSPVEKSIKANNGYVPQKEKPSPFKDGSSEDTEEECNSVNTSNSEPKSSKSAKKNKWKHDEVKKLIGMRGEMNDRFQVVKGRMALWEEISQNLLSNGISRSPGQCKSLWTSLLQKYEEVKNEKNGKKKWPYLEEMERILSDSETLASK

SEQ ID NO: 14345 - protein, 881 aa, Cajanus cajan
MATCTSLSLSPHTFCCRHRPYPTRRSLTCSLSSSPLPDTDGPKVLRKRSRRTEGPKKSMEDSVQRKMEEFYEGRDGPPLRVLPIGGLGEIGMNCMLVGNYDRYILIDAGVMFPDYDELGVQKIIPDTTFIRKWRHKIEAVVITHGHEDHIGALPWVIPALDSHTPIFASSFTMELIRKRLKDHGIFVPSRLKVFRTRKKFVAGPFEIEPITVTHSIPDCCGLVLRCSDGTILHTGDWKIDETPLDGRVFDREALEELSKEGVTLMMSDSTNVLSPGRTISESVVADALLRKISAAKGRVITTQFASNIHRLGSVKAAADLTGRKLVFVGMSLRTYLDAAWKDGKAPIDPSTLVKAEDIDAYAPKDLLIVTTGSQAEPRAALNLASYGSSHSFKLTKEDVVLYSAKVIPGNESRVMEMLNRISEIGSAIIMGKNECLHTSGHGYRGELEEVLRIVKPQHFLPIHGELLFLKEHELLGKSTGIRHTTVIKNGEMLGVSHLRNRRVLSNGFMSFGKENLQLMYSDGEKAFGTSSELFIDERMRIALDGIIVVSMEIFRPQSLDNPDENTLKGKIRITTRCLWLDKGKLLDALHKAAHAALSSCPVSCPLAHMERIVSEVLRKMVRKYSGKRPEVIAIAIENPAAVLANEINTRLSGKFHVDGISPLRKVVDGKENLRTKKQIRGNINLHLKNTYRIVEIWLVCFYGLPPTEDITISSGYEDDLSETGDSDAILKPFVESSPVEKSIKANNGYVRRKEKLSPLRDDGSEDTEECNSVDTSNSEPKSSKSAKRNKWKHDEVRKLIGMRGELNDKFQVVKGRMALWEEISQNLLANGISRSPGQCKSLWTSLLQKYEEVKNVKSKKKWPYLEDMERILSDNEALATK

SEQ ID NO: 14346 - protein, 1736 aa, Glycine max
MKKATNPNPFSTPRRHDFHRPPPPTHGCGWTPRPVHHRPYHQWRPRFHPHAARIDRPPEPYFRVELRLGRCPLHRDDVEALIDECRSSHDSFTFYPTDDVAAVLNYRSWEQARDAVVWFWEARLAEKHDFTPALDSNVVVVKDDVDCRLRPVFARHVKGLMMMEEGKEVKFGMDECERLAKEISRLSSSLSKPLRIGTQNELMKKKKGLVDEKNLVERRLKEFESAMQCLLKYLEDGGDDVEGVKVFRFDGGFDWKRIHCLIKRECRRLEDGLPIYAYRRDILQEIHYQQIMVLIGATGSGKSTQLVQFLADSGVGSDKSIVCTQPRKIAAKAVAQRVQQESSGCYEGQSIKYCSTFLSSREFDSRITFMTDHSLLQHYMSDNNLSGVSCIIIDEAHERSLNTDFLLTLLKSLLCRRVEMRLIIMSATADAKQLSDYFFGCGIFHVLGRSFPVDIKYVPSDCGGDSGSAVVASYVSDVVRMATEIHKTEKEGTILAFLTSQIEVEWACEKFQAASAVALPLHGKLSSDEQFRVFQNYPGKRKVIFSTNLAETSLTIPGVRYVIDSGVVKDSRFDPSSGMSVLKVCWISQSSADQRAGRAGRTEPGVCYRMYLEADYQSMDLNTEPEIRKVHLGVAVLRILALGVKDMQDFDFVDAPSPSSIDMAIRNLIQLGAIELNNNAHDLTSEGWCLVRMGIEPRLGKLILGCFKHGLGREGIILAAVMANASSIFCRVGSEFDKQRSDCLKVQFCHCDGDLFTLLSVYKEWEALPRERKNKWCWENSINAKSIRRCQDTILELETCLEREHDIVTPSYWLWDPCMPSNHDKNLKRVILSSLVENVAMYSGCNQLGYEVAQTGQHVQLHPSCSLLVFAEKPSWVVFGELLSISNQYLVCVCAFDFQSLFNLCPAPLFDVSKMEERKLLMKTLSGLGCILLKRFCGKANCDLLALVSRIRKACMDERIFIEVNVDKNEIHLYATSNEMDIALGLVNGVLEYERKLLRTECMDKFLYHGSGFSPPVALFGSGAEIKHLELEKRSLSVDVCHPNINEIDDRELLMFFEKNTSGCICAVHKFTGNMRDGDRDKWGRIIFMSPDVVRRAAELDGQEFCGSSLKIVPSQLGWDKTFSFPAVKARISWPRRLSRGFAIVKCDIKDVNYILRDFYNLAVGGRYVRCEIGKKSIDSVVINGLDKELSEAEIVDVLRTATSRRILDFFLVRGDAAGNPPCSALEEALLKEIYPFLPKRNPHIIPCRVQVFAPEPKDSFMRALITFDGRLHLEAAKALEQIEGKVLPGCLSWQKIKCQQLFHSSIIFPTPVYHVIKEQLDEVLASFRNLKGLECNLGRTVNGSHRVKITANATRTVAEVRRPLEELLRGKTIEHDSLTPVVFQLMLSRDGFSLKNSLQQETGTYILFDRHNLNLRVFGSPNKVALAQEKVIQSLLSLHEEKQLEIHLRGMDLPPDLMKQMIKNFGPDLRGLKERVPGVDLTLNTRRHIVILHGSKELKPRVEEIIFEIARSSHHLVERFENGPSCPICLCEVEDGYRLEGCGHLFCRLCLVEQFESAINNQGTFPVCCTHRDCGDPILLTDLRSLLFGDKLEDLFRASLGAFVATSGGAYRFCPSPDCPSIYRVADPESAGEPFVCGSCYSETCTRCHLEYHPYLSCERYQEFKEDPDSSLKEWCRGKEQVKCCSACGYVIEKVDGCNHVECKCGKHVCWVCLEFFSTSNDCYNHLRTIHLAII

SEQ ID NO: 14347 - protein, 1730 aa, Phaseolus vulgaris
MKKTSYPNPTYRRCDAHSDAPPHGCSTPRPIFHRPFHQSRPRFYPHPVRLHRPPEPYFKVELRFSLRPPSRDEVEALIKECEHEPQSFAFYPGDDVAAALSYRNWEEACDAAAWFWESLLLEKHGYTPALDSNVAVTGDLDGRLRVLFTRHVQRVMEGREVKRWVEESERLSKEIARVSTLLRNGLHIDLSSHYIEQKKGLNVEKNQVERRLKEFESAMDCILKYLAEGDDEEGGGSVNVFKFDGCFDWNRIHCLIRRECRRLEDGLPIYTYRTDILREIHYQQIMVLIGETGSGKSTQLVQFLADSGIGADESIVCTQPRKIAARSVAQRVQEESSGCYEGQSIKCSMFSSLHEFDSRIIFTTDHCLLQHYMRDNNLSGISCIIIDEAHERSLNTDLLMTLLKNLLYRRGEMRLIIMSATADAKQLSDFFYCCGIFRVTGRSFPVDVKYVPSDHAGHSGSVGVASYVSDVVRKATEVHKTEKEGTIIAFLTSQIEVEYACEKFQIPSAVALPLHGKLSSEEQFRVFQNYPGKRKVIFSTNLAETSLTIPGVKYVIDSGLFKDCRYDPGSGMNVLKVCWISQSSADQRAGRAGRTEPGVCYRLYSETDYQSMDLNQEPEIRRVHLGVAVLRILALGVTNVQDFDFVDAPSSSSIDMAIRNLIQLRAIEKKNDVHNLTPEGWCLVKIGIEPRLGKLILGCFKDGLGREGIVLAAVMANASTIFCRVGSEFDKQRSDCLKVQFCHCDGDLFTLLSVYKEWEALPLERRNKWCWENSINAKSMRRCQDTVLELESCLEREHDLVTPSCWRWDPCMPSSYDKNLKRVILSSLAENVAMYSGCNQLGYEVAQTGQHVQLHPSCSLLVFAQKPSWVVFGELLSVSNQYLVCVSTFDFQSLYDLRPAPLFDVSKMVERKLQMKTLCGLGCILLKRFCGKANCNLLALISRIRKACMDERIYIEVNVDQNAIHLFATSNDMDAALVLVNGALEYERKLQRAECMDKCLYHGSGLSPPIALFGSGAEIKHLELEKRSLSIDVCHADINAIDDKELLMFLEKNTSGSICAVYKFSGNMKDEDKDKWGRILFTSPDFVERATELDGHEFCGSSLKILPSQLGGDKMFSFPAVKAKVSWPRRSSRGFAVVKCDIKDVNHILRDFYNLAIGGRYVRCEVGKKSMDSVTINGLGKDLSEAEILDVLRTATSRRILDFFLVRGDAVENPPCSALEEALLKEIYPSLPKRNPHISSCRVQVFVPEPKDAFMRALISFDGRLHLEAAKALEQIEGKVLPGCLSWQKIKCQRLFHSSLIFPIPVFRVIREQLDGVLARFRNLKGVECNLDRTVNGSHRVKITANATKTVAEVRRPLEELLRGKTVEHDSLTPAVLQLLMSKDGFNLKNSLQQETGTYILFDRHNLNLRVFGSPNKVALAHDKLIQSLLSLHEEKQLKIHLRGRDLPPDLMKQMIKNFGPDLRGLKERVPGVDLMLNINRHVISLNGRKELKPRVEEIIFEIARSSHHLVGTFDNDGPNCPICLCEVEDAYRLEGCGHVFCRLCLVEQCESAIRNQGTFPICCTNKDCGDIILLTDLRSLLVGDKLEDLFRASLGAFVTTSGGTYRFCPSPDCPSIYRVADPGTAGEPFVCGACYSETCTRCHLEYHPYLSCERYKEFKEDPDSSLIQWCRGKDEVKSCLACGYVIEKVDGCNHVECKCGKHVCWVCLEFFSASDECYSHLRNVHKTII

SEQ ID NO: 14348 - protein, 314 aa, Glycine max
MKRLNSSDSSTALMTIFPSSSTEEHSPRNSHHMYGREFRSMLDGLDEEGCVEEPGHQSEKKRRLSVEQVKALEKNFEVENKLEPERKVKLAQELGLQPRQVAVWFQNRRARWKTKQLERDYGVLKANYDALKLNFGTLNQDNEALRKQIKELKSRLLQEENTAGSGVSVKEEEITTMPADSEEKTMEQSKSDPPSETSNINPSSESSEEDHLNYECFNNNSDDCVVGGSAAASLLQVDFMKDGSSDSDGSSAILNEDTMYLPSSMNCFQFQKPYHHAQYVKTEEHNFLSADEACNFFSDEQAPTLQWYCPEQWS

SEQ ID NO: 14349 - protein, 333 aa, Glycine max
MDYICFFVTFTAIALLGFVSVVFFEAYKRRNNHQHIEVPAIFEDPSSLKQVPCPHIVDPATKYISLIIPAFNEEHRLPGALEETMNYLHQRTLKDSSFTYEVVIIDDGSADETKRVAFEFVRKYTVDKVRVILLGRNHGKGEAIRKGMMHSRGELLLMLDADGATKVTDLEKLENQIQAVAKREYHHGDSSDSDPRFRISDIPAAVFGSRAHLEEKALATRKWYRNFLMKGFHLVVLMAAGPGICDTQCGFKMFTRAAARKLFSNVRLKRWCFDVELVFLCKWFRISISEISVNWSEIPGSKVNLLSIPNMLWELVLMSVGYRTGMWRISNSA

SEQ ID NO: 14350 - protein, 333 aa, Cajanus cajan
MEFVCLFVTFTAIAVLGLAFVVFFEAYKRRNNHEHIEVPAIFEDPSSLKQVPCPHIVDPATKYISLIIPAFNEEHRLPGALEETMNYLQQRSSKDPSFSYEVLIIDDGSADETKKVAFEFVRKYTVDKVRVILLGRNHGKGEAIRKGMLHSRGELLLMLDADGATKVTDLEKLENQIQAVAKREYHQGDSGDSDPRFRISDIPVAVFGSRAHLEEKALATRKWYRNFLMKGFHLVVLMAAGPGIRDTQCGFKMFTRAAARKLFSNVRLKRWCFDVELVFLCKWFRIPVSEISVNWSEIPGSKVNLLSIPNMLWELVLMSVGYRTGMWRVSNST

SEQ ID NO: 14351 - protein, 333 aa, Phaseolus vulgaris
MEYTCLLITFSATAILGFVFVVFFEAYKRRNNHQHIEVPAIFEDPSSLKQVPCPHIVDPATKYISLIIPAFNEEDRLPGALDETMNYLQRRTLKDPSFTYEVIIIDDGSADDTKRVAFEFVRKYTVDKVRIILLGRNHGKGEAIRKGMLHSRGELLLMLDADGATKVTDLEKLENQIQAVAKSKYHQGDSSNTDPRFRISDIPVAVFGSRAHLEEKAIATRKWYRNFLMKGFHLVVLLAAGPGIRDTQCGFKMFTRAAARKLFSNVHLKRWCFDVELVFLCKRFKIPISEVSVNWSEIPGSKVNLLSIPNMLWELVLMSVGYRTGMWRISNST

SEQ ID NO: 14352 - protein, 333 aa, Lupinus angustifolius
MEYICLLATFFVIVVLGFVSVIFFEAYRRRNNHEHVAVPAIFEDPNSLKQVPCPHVVDPAAKYISLIIPAFNEEHRLPGALDETMNYLQQRASKDPSFSYEVVIIDDGSADGTKKVAFEFVKKYTVDKVRVILLGRNHGKGEAIRKGMLHSRGELLLMLDADGATKITDLEKLENQIHAVAKKEFNSRDSSASDPSFRISDIPIAVFGSRAHLEEKALASRKWYRNILMKGFHLVVLLAAGPGIRDTQCGFKMFTRAAARKLFSNVRLKRWCFDVELVFLCKCFRIPIFEISVNWSEIPGSKVNLLSIPNMLWELVLMSVGYRTGMWRISNST

SEQ ID NO: 14353 - protein, 333 aa, Cicer arietinum
MEFMCLIVTLSVILVLGLVFVIFLEAYRRRNNHQHIEVPAIFEDPNSLKQVPCPHVVDPASKYISLIIPAFNEEHRLPGALEETMIYLQQRASKDPSFSYEVVIVDDGSVDGTKRVAFEFVRKYTVDKVRVILLGRNHGKGEAIRKGMLHSRGELLLMLDADGATKITDLEKLENQIRAVAEKEFHHGDSSGNDPSFRISDTPVVVFGSRAHLEEKALATRKWYRNFLMKGFHLVVLLAAGPGIRDTQCGFKMFTRAAARKLFSNVRLKRWCFDVELVFLCKWFRIPISEISVNWSEIPGSKVNLLSIPNMVWELLLMSVGYRIGIWRISNST

SEQ ID NO: 14354 - protein, 189 aa, Trigonella foenum-graecum
MEFICLIGTFAVILVLGFFFVIFFEAYRRRNNHQHIEVPAIFEDPNSLNQVPCPHVVDPASKYISLIIPAYNEEHRLPGALEETMIYLQHRASKDPSFSYEVVIIDDGSVDGTKRVAFEFVKKYTVDKVRVILLGRNHGKGEAIRKGMLHSRGELLLMLDADGATKITDLEKLENQIRAVAKKGWRFKW

SEQ ID NO: 14355 - protein, 330 aa, Medicago truncatula
MEFLCLIVTFAVTLMLGFFLVIFVEAYRRRNNHQHIEVPAIFEDPNSLTQVPCPHVVDPASKYISLIIPAYNEEHRLPGALEETMIYLQHRASKDPSFSYEVVIVDDGSVDGTKRVAFEFVRKYTVDKVRVILLGRNHGKGEAIRKGMLHSRGELLLMLDADGATKITDLEKLENQIRAVAKKDGDSSGSDSSFRMSDTPVVVFGSRAHLEEKALATRKWYRNFLMKGFHLVVLLAAGPGIRDTQCGFKMFTRAAARKLFSNVRLKRWCFDVELVFLCKWFRIPISEISVIWSEIPGSKVNLLSIPNMVWELLLMSVGYRIGVWRISNST

SEQ ID NO: 14356 - protein, 334 aa, Arachis hypogaea
MEEYMYLLVNFFLIAVVGFIFVVIVEAYRRRNNHLHVEVPAIFEDPNSLKQVPCPHVVDPAEKYMSLIIPAFNEEHRLPGALEETMNYLQQRASKDPSFSYEVVIIDDGSADGTKRVAFEFVRKYTVDKVRVILLGRNHGKGEAIRKGILHSRGELILMLDADGATKVTDLEKLENQIQVIAKKQFQQGKSSPSDPTFRVSDIPVAAFGSRAHLEEKALATRKWYRNFLMKGFHLVVLLAAGPGVRDTQCGFKMFTRAAARRLFSNVRLRRWCFDVELVFLCKWFRIPISEISVNWSEIPGSKVNLMSIPNMLWELVLMSAGYRTGMWRISGST

SEQ ID NO: 14357 - protein, 708 aa, Glycine max
MELQRRPDQCLPERKGQKRKLEEEFDDDPQISPPPTGDARDALLSDVKEQVSLLDSTFSWNEPDRAAAKRATHALADLAKNEEVVNVIVEGGAIPALVKHLQVPPLPLPETDRVPRPMPFEHEVEKGSAFALGLLAVKPEHQQLIVDSGALKHLVDLLKRHKNGLTSRAINSLIRRAADAITNLAHENSSIKTRVRKEGGIPPLVHLLEFADTKVQRAAAGALRTLAFKNDENKNQIVECNALPTLILMLCSEDAAIHYEAVGVIGNLVHSSPDIKKEVLLAGALQPVIGLLSSCCSESQREAALLLGQFAATDSDCKVHIVQRGAVRPLIEMLQSSDVQLKEMSAFALGRLAQDTHNQAGIAHNGGLMPLLKLLDSKNGSLQHNAAFALYGLADNEDNVSDFIRVGGIQRLQDGEFIVQATKDCVAKTLKRLEEKIHGRVLNHLLYLMRVSEKAFQRRVALTLAHLCSADDQRKIFIDYNGLELLMGLLGSYNPKQQLDGAVALCKLANKAMTLSPVDAAPPSPTPQVYLGEQYVNNVTLSDVTFLVEGKRFYAHRICLLASSDAFRAMFDGGYREKEARDIEIPNIRWEVFEPMMRFIYTGSVDITLDIAQDLLRAADQYLLEGLKRLCEYTIAQDISLENVSSMYELSEAFNAISLRHTCILFILEHYDKLSGKPGHSHLIQRIIPEIQNYFVKALTKANSNILP

SEQ ID NO: 14358 - protein, 706 aa, Cajanus cajan
MELQRRPDQCLPERKGQKRKLEEEFEEDRQISAPPTGDARDALLSDVQEQVSVLDSTFSWKESDRAAAKRATHALADLAKNEEVVNVIVEGGAIPALVKHLQAPPLSETDRVQRPLPFEHEVEKGSAFALGLLAVKPEHQQLIVESGALKYLVDLLKRHKNGLTSRAINSLIRRAADAITNLAHENSSIKTRVRMEGGIPPLVHLLEFADTKVQRAAAGALRTLAFKNDENKNQIVECNALPTLILMLRSEDAAIHYEAVGVIGNLVHSSPNIKKEVLHAGALQPVIGLLSSCCSESQREAALLLGQFAATDSDCKVHIVQRGAVRPLIEMLQSSDVQLKEMSAFALGRLAQDTHNQAGIAHNGGLMPLLKLLDSKNGSLQHNAAFALYGLADNEDNVPDFIRVGGIQKLQDGEFIVQATKDCVAKTLKRLEEKIHGRVLNHLLYLMRVSEKAFQRRVALALAHLCSSDDQRKIFIDHHGLELLMGLLGSYNPKQQLDGAVALCKLANKAMTQSPVDAAPPSPTPQVYLGEQYVNNATLSDVTFLVEGKRFYAHRICLLASSDAFRAMFDGGYREKEARDIEIPNIRWEVFELMMRFIYTGSVDVTLDIAQDLLRAADQYLLEGLKRLCEYTIAQDISLENVSCMYELSEAFNATSLRHTCILFILEHYDKLSGKPGHSHLIQRIIPEIQNYFVKALTKANSNLQL

SEQ ID NO: 14359 - protein, 707 aa, Phaseolus vulgaris
MDLHARPDHCLPERKGQKRKLEEDFEDDRQISAPPTGHARDALLSDVKEQVIVLDSTFSWKESDRAAAKRATHALADLAKNEEVVNVIVEGGAIPALVKHLKAPPLVGSDLLQRPMPFEHEVEKGSAFALGLLAVKPEHQQLIVDSGALKHLVDLLKRHENGLTSRAINSLIRRAADAITNLAHENSSIKTRVRIEGGIPPLVHLLEFADTKVQRAAAGALRTLAFKNDENKNQIVECNALPTLILMLRSEDAAIHYEAVGVIGNLVHSSPNIKKEVLLAGALQPVIGLLSSCCSESQREAALLLGQFAATDSDCKVHIVQRGAVRPLIEMLQSPDVQLKEMSAFALGRLAQDTHNQAGIAHNGGLIPLLKLLDSKNGSLQHNAAFALYGLADNEDNVADFIRVGGIQRLQDGEFIVQATKDCVAKTLKRLEEKIHGRVLNHLLYLMRVSEKAFQRRVALALAHLCSADDQRKIFIEHHGLELLMGLLGSYYNSKQQLDGAVALCKLANKGTTLSPVDAAPPSPTPQVYLGEQYVNNATLSDVTFLVEGKRFYAHRICLLASSDAFRAMFDGGYREKEARDIEIPNIRWEVFELMMRFIYTGSVEITLDIAQDLLRAADQYLLEGLKRLCEYTIAQDISLESVSSMYELSEAFNAISLRHTCILFILEHFDKLSGKPGHSHLIQRIIPEIQNYFGKALTKGISNNQP

SEQ ID NO: 14360 - protein, 706 aa, Cicer arietinum
MELQRRPDHNLQEKKGLKRKLEDEFEQDSQISLPPTGEARDALLSDVNQHVSILLSTFSSNESDRASAKRATHALADLAKNEEVVNVIVEGGAVPALIMHLQPPPLLENDPVQKPLPFEHEVEKGSAFALGLLAVKPEHQQLIVDSGALKHLVDLLKRHKNGLTSRAINSLIRRAADAITNLAHENSSIKTRVRMEGGIPPLVNLLEFADTKVQRAAAGALRTLAFKNDENKNQIVECDALPTLILMLRSEDAAIHYEAVGVIGNLVHSSPNIKKEVILAGALQPVIGLLSSCCSESQREAALLLGQFAATDSDCKVHIVQRGAVRPLIEMLQSPDVQLREMSAFALGRLAQDAHNQAGIAHTGGLMPLLKLLDSKNGSLQHNAAFALYGLADNEDNVPDFIRVGGIQRLQDGEFIVQATKDCVAKTLKRLEEKIHGRVLNHLLYLMRVSDKAFQRRVALALAHLCSADDQRKVFVDHNGLELLIGLLCSSSPKQQLDGAVALCKLANKATAVSPVDAAPPSPTPQVYLGEQYVNNATLSDVTFLVEGKRFYAHRICLLASSDAFRAMFDGGYREKDARDIEIPNIRWEVFELMMRFIYTGSVDITLDIAQDLLRAADQYLLEGLKRLCEYTIAQDVSLENVSSMYELSEAFNAISLRHTCILFILEHFEKLSARPGHSHLILLIIPEIRNYFVKALSKGSSSIQA

SEQ ID NO: 14361 - protein, 707 aa, Arachis hypogaea
MELQGPSDQCHPERKGQKRKLEDEFEEDHHQISTPPTGDARDAILADVQEQVSILNSTFSWKESDRAAAKRATHALADLAKNEEVVNVIVEGGAIPALVQHLQAPLVTEEDLVQKLLPFEHEVEKGSAFALGLLAVKPEHQQLIVDNGALKHLVDLLKRHKNGLTSRAINSLIRRAADAITNLAHENSCIKTRVRMEGGIPPLVHLLEFADTKVQRAAAGALRTLAFKNDENKNQIVECNALPTLILMLRAEDAAIHYEAVGVIGNLVHSSPNIKKEVLLAGALQPVIGLLSSCCSESQREAALLLGQFAATDSDCKVHIVQRGAVRPLIEMLHSPDVQLREMSAFALGRLAQDTHNQAGIAHNGGLVPLLKLLDSKNGSLQHNAAFALYGLADNEDNVSDFIRVGGIQRLQDGEFIVQATKDCVAKTLKRLEEKIHGRVLNHLLYLMRVSEKAFQRRVALALAHLCAAEDQKKIFIDHHGLELLIGLLGSSSPKQQLEGAVALFKVANKAMTLSPVDAAPPSPTPQVYLGEQYVNNSTLSDVTFLVEGKRFFAHRICLLASSDAFRAMFDGGYREKDARDIEIPNIRWEVFELMMRFIYTGSVDVTLDIAQDLLRAADQYLLEGLKRHCEYTIAQDISLENVSSMYELSEAFNAISLRHACILFILEQFDKLSARPGHTLLIQRITPEIRNYFVKALTKANSNTQL

SEQ ID NO: 14362 - protein, 706 aa, Phaseolus vulgaris
MELQRRQDQSLSQRKGQKRKLDDEHHDEGQISAAPPTADERAALLYDVAEQVSVLESTFTWNEVDRSAAKRATHALADLAKNEEVVNVIVEGGAIPALVKHLQAPPLVDRVEKPLPFEHEVEKGSAFALGLLAVKPEHQQLIVDSGALIHLVDLLKRHKDGLTSRAINSLIRRAADAITNLAHENSSIKTRVRMEGGIPPLVHLLDFADAKVQRAAAGALRTLAFKNDENKNQIVECNALPTLILMLRSEDAAVHYEAVGVIGNLVHSSPNIKKEVLLAGALQPVIGLLSSCCSESQREAALLLGQFAATDSDCKVHIVQRGAVQPLIEMLQSSDVQLREMSAFALGRLAQDTHNQAGIAHNGGLVPLLKLLDSKNGSLQHNAAFALYGLADNEDNVSDFIRVGGVQRLQDGEFIVQATKDCVAKTLKRLEEKIQGRVLNHLLYLMRVSEKGCQRRVALALAHLCSADDQRKVFIDHYGLELLIGLLGSSSSKQQLDGAVALCKLANKASTLSPIDAPPLSPTPQVYLGEQYVNNATLSDVTFLVEGKQFYAHRICLLASSDAFRAMFDGGYREKEARDIEIPNIRWEVFELMMRFVYCGSVDVTLDIAQDLLRAADQYLLEGLKRLCEYTIAQDISLENVSSMYELSEAFNAVPLRHACILFILEQFDKLSARPGHSLLIQRVIPEIRNYFVKALTKANSHNNRL

SEQ ID NO: 14363 - protein, 707 aa, Glycine max
MELQRRQDQSLSQRKGQKRKLDEEQHHEDRQISPAPPTADERAALLSDVAEQVSILESTFTWNEADRSAAKRATHALADLAKNEDVVNLIVEGGAIPALVKHLQAPPLSDRVQNPLPFEHEVEKGSAFTLGLLAVKPEHQQFIVDSGALTHLVDLLKRHRNGLTSRAINSLIRRAADAITNLAHENSSIKTRVRMEGGIPPLVHLLDFADAKVQRAAAGALRTLAFKNDENKNQIVECNALPTLILMLRSEDAGVHYEAVGVIGNLVHSSPNIKKEVLLAGALQPVIGLLSSCCSESQREAALLLGQFAATDSDCKVHIVQRGAVQPLIEMLQSPDVQLREMSAFALGRLAQDPHNQAGIAHNGGLVPLLKLLDSKNGSLQHNAAFALYGLADNEDNASDFIRVGGVQRLQDGEFIVQATKDCVAKTLKRLEEKIHGRVLNHLLYLMRVSEKGCQRRVALALAHLCSSDDQRIIFIDHYGLELLIGLLGSSSSKQQLDGAVALCKLADKASTLSPVDAAPPSPTPQVYLGEQYVNNATLSDVTFLVEGKRFYAHRICLLASSDAFRAMFDGGYREKEARDIEIPNIRWEVFELMMRFVYCGSVDVTLDIAQDLLRAADQYLLEGLKRLCEYTIAQDISLENVSSMYELTEAFNAISLRHACILFILEQFDKLSSRPGHSLLIQRITPEIRNYFVKALTKANSQNDRL

SEQ ID NO: 14364 - protein, 696 aa, Cajanus cajan
MEFQRRQDQSLSQRKGQKRKLDEEHHHERQISPPPPTAVERAALLSDVAEQVSILESTFTWNEADRSAAKRATHALADLAKNEEVVNVIVEGGAIPALVKHLQAPPLSDRVQKPLPFEHEVEKGSAFALGLLAVKPEHQQLIVDSGALTHLVDLLKRHKNGLTSRAINSLIRRAADAITNLAHENSSIKTRVRMEGGIPPLVHLLDFADAKVQRAAAGALRTLAFKNDENKNQIVDCDALPTLILMLRSEDAAVHYEAVGVIGNLVHSSPNIKREVLLAGALQPVIGLLSSCCSESQREAALLLGQFAATDSDCKVHIVQRGAVRPLIEMLQSPDVQLREMSAFALGRLAQDTHNQAGIAHNGGLVPLLKLLDSKNGSLQHNAAFALYGLADNEDNVSDFIRVGGVQRLQDGEFIVQATKDCVAKTLKRLEEKIHDRVLNHLLYLMRVSEKGCQRRVALALAHLCSADDQRQIFIDHYGLELLLGLLGSSSSKQQLDGAVALCKLANKASTLSPVDAAPPSPTPQVYLGEQYVNNATLSDVTFLVEGKRFYAHRICLLASSDAFRAMFDGGYREKEARDIEIPNIRWEVFELMMRFVYCGSVDVTLDIAQDLLRAADQYLLEGLKRLCEYTIAQDISLENVSSMYELSEAFNAISLKHACILFILEQFDKLSARPGHSLLIQRIIPEIRNYFVQTL

SEQ ID NO: 14365 - protein, 707 aa, Glycine max
MELQRRQDQSLSQRKGQKRKLDEEQHHEDRQILPAPPTADERAALLSDVAEQVSILESTFTWNEADRSAAKRATHALADLAKNEDVVNVIVEGGAIPALVKHLQAPPLSDLVQHPLPFEHEVEKGSAFALGLLAVKPEHQQLIVDSSALTHLVDLLKRHRNGLTSRAINSLIRRAADAITNLAHENSNIKTRVRMEGGIPPLAHLLDFADAKVQRAAAGALRTLAFKNDENKNQIVECNALPTLILMLRSEDAAVHYEAVGVIGNLVHSSPNIKKEVLLAGALQPVIGLLSSCCSESQREAALLLGQFAATDSDCKVHIVQRGAVRPLIEMLQSPDVQLREMSAFALGRLAQDPHNQAGIAHNGGLVPLLKLLDSKNGSLQHNAAFALYGLADNEDNVSDFIRVGGVQRLQDGEFIVQATKDCVAKTLKRLEEKIHGRVLNHLLYLMRASEKGCQRQVALALAHLCSSDDQRIIFIDHYGLELLIGLLGSSSSKQQLDGAVALSKLANKALTLSPVDAAPPSPTPQVYLGEQYVNNATLSDVTFLVEGKRFYAHRICLLASSDAFRAMFDGGYTEKEARDIEIPNIRWEVFELMMRFVYCGSVDVTLDIALDLLRAANQYLLEGLKRLCEYTIAQDISPENVSSMYELSEAFNAISLRHACILFILEQFDKLSSRPGHSLLIQRIIPEIRNYFVKALTKANSHDNQL

SEQ ID NO: 14366 - protein, 705 aa, Cicer arietinum
MEFQRRQDHCLSERKGQKRKLDEELHDERQISAAAPPTADERAKLLAEVANQVTILESTFTWNEADRSAAKRATHALADLAKNEEVVNVIVEGGSIPALIKHLQAPPLSDSVQKPLPFEHEVEKGSAFALGLLAVKPEHQQLIVDNGALTHLVDLLKRHKNGLTSRAINSLIRRAADAVTNLAHENSNIKTRVRMEGGIPPLVHLLEFADAKVQRAAAGALRTLAFKNDENKNQIVECNALPTLILMLRSEDSAIHYEAVGVIGNLVHSSPNIKKEVLLAGALQPVIGLLSSCCSESQREAALLLGQFAATDSDCKVHIVQRGAVRPLIEMLQSPDVQLREMSAFALGRLAQDTHNQAGIAHNGGLVPLLKLLDSKNGSLQHNAAFALYGLADNEDNVSDFIRVGGVQRLQEGEFIVQATKDCVAKTLKRLEEKIHGRVLNHLLYLMRVSERGFQRRIALVLAHLCSADDQRRIFIEHHGLELLIGLLGSSSSKQQLDGAVALCKLANKVSTLSPVDAAPPSPTPQVYLGEQYVNSATLSDVTFLVEGKRFYAHRICLLASSDAFRAMFDGGYREKDARDIEIPNIRWEVFELMMRFIYTGSVDVTSDIAQDLLRAADQYLLEGLKRLCEYTIAQDILLENVSSMYELSEAFNAISLRHTCILFILEHFDKLSTRPGHPLLIQRIIPEIRKYFVKALTNGNSHNS

SEQ ID NO: 14367 - protein, 242 aa, Trigonella foenum-graecum
MEFQRRQGHCFSERKGQKRKLDEELTEDRQISSAPPTADERAALLAEVAKQVSVLESTFTWNEADRAAAKRATHALADLAKNEEVVNVIVEGGAIPALIKHLQAPPVTDCVQKPLPFEHEVEKGSAFALGLLAVKPEHQQLIVDSGALTHLVDLLKRHNNGLTSRAINSLIRRAADAVTNLAHENSNIKTHVRMEGGIPPLVHLLEFADTKVQRAAAGALRTLAFKNDEIKFRLLNVMLFRL

SEQ ID NO: 14368 - protein, 704 aa, Theobroma cacao
MELQRSQDQGLPERKGQKRKLEEENQEDRETSLPTGDARRALLAEVTAQVSVLDSTFSWREPDRAAAKRATHVLAELAKNEEVVNVIVEGGAVPALVKHLQAPPCSDGDRSPKPFEHEVEKGSAFALGLLAVKPEHQQLIVDSGALSHLVNLLRRHKDGSTSRAVISVIRRAADAITNLAHENSSIKTRVRMEGGIPPLVELLDFTDTKVQRAAAGALRTLAFKNDENKNQIVECNALPSLILMLRSEDAAIHYEAVGVIGNLVHSSPNIKKEVLAAGALQPVIGLLTSCCSESQREAALLLGQFAATDSDCKVHIVQRGAVRPLIDMLHSPDVQLKEMSAFALGRLAQDTHNQAGIAHNGGLVPLLKLLDSKNGSLQHNAAFALYGLADNEDNVSDFIMVGGVQRLQDGEFIVQATKDCVAKTLKRLEEKIHGRVLNHLLYLMRVAEKPVQRRVALALAHLCSPEDQRTIFIDNNGLELLLGLLGSTSPKQQLDGAVALYKLANKAMSLSPMDAAPPSPTPQVYLGEQYVNNATLSDVTFLVEGRRFYAHRICLLASSDAFRAMFDGGYREKDARDIEIPNIRWEVFELMMRFIYTGSVDVTLDIAQDLLRAADQYLLEGLKRLCEYTIAQDISLENVSSMYELSEAFHAISLRHTCILFILENFDKLSTRPGHLHLIQRIIPEIRNYFAKALTKPNPHNLRL

SEQ ID NO: 14369 - protein, 693 aa, Lotus japonicus
MEFQRRQDHSLSERKGQKRKLDDQLHDDRQISLSPPTADERAALLADVAVQVSVLDSTFTWNESDRAAAKRATHALADLAKNEEVVNVIVEGGAIPALVKHLQAPPLSDFAQKPLPFEHEVEKGSAFALGLLAVKPEHQQLIVDSGALTHLVDLLKRQKNGLTSRAINSLIRRAADAITNLAHENSSIKTSVRMEGGIPPLVHLLEFADTKVQRAAAGALRTLAFKNDENKNQIVECNALPTLILMLRSEDAAIHYEAVGVIGNLVHSSPNIKKEVLLAGALQPVIRLLSSCCSESQREAALLLGQFAATDSDCKVHIVQRGAVRPLIEMLQSPDVQLREMSAFALGRLAQDTHNQAGIAHNGGLVPLLKLLDSKNGSLQHNAAFALYGLADNEDNVSDFIRVGGVQRLQEGEFIVQATKDCVAKTLKRLEEKIHDQKGFQRRVALALAHLCSADDQRRIFIDNHGLELLIGLLGSSSSKQQLDGAVALCKLANKASTLSPVDAAPPSPTPQVYLGEQYVNNATLSDVTFLVEGKRFYAHRICLLASSDAFRAMFDGGYREKDARDIEIPNIRWEVFEMMMRFIYTGSVDITVDIAQDLLRAADQYLLEGLKRLCEYTIAQDISLENVSCMYELSEAFNAISLRHACILFILEQFHKLSERPGHSLLIQHIIPDIRSYFVKALSKTNSHNYRL

SEQ ID NO: 14370 - protein, 703 aa, Trigonella foenum-graecum
MDLLPTEKKKGQKRKLEVEEEQFQQDTQISLPLTGEAHDAILSDVNQHVSILLSTFSSNDSDRASAKRATHALADLAKNEEAVNVIVEGGAVPALIKHLQPPPHENNFVQKPLPFEHEVEKGSAFALGLLAVKPEHQQLIVDSGALKHLVDLLKRHKNGLTSRAINSLIRRAADAITNLAHENSSIKTRVRTEGGIPPLVHLLEFADTKVQRAAAGALRTLAFKNDENKNQIVECNALPTLILMLRSEDAAIHYEAVGVIGNLVHSSPNIKKEVILAGALQPVIGLLSSCCSESQREAALLLGQFAATDSDCKVHIVQRGAVRPLIEMLQSSDVQLREMSAFALGRLAQDTHNQAGIAHTGGLMPLLKLLDSKNGSLQHNAAFALYGLAENEDNVPDFIRVGGIKRLQDGEFIIQATKDCVAKTLKRLEEKIHGRVLNHLLYLMRVSEKAFQRRVALALAHLSSADDQRKIFIDHNGLEVLIGLLGSSCPKQQLDGAMALFKLANKAMTLSPVDAAPPSPTPQVYLGEQYVNNATLSDVTFLVEGKRFYAHRICLLASSDAFRAMFDGGYREKDARDIEIPNIRWEVFELMMRFIYTGSVDVTLEIAQDLLRAADQYLLEGLKRLCEYTIAQHVSLENVSSMYELSEAFNAISLRHTCILFILGHFDKLRETSGNSDFIQNTIPEIRNYFVNALAKGNSSIQA

SEQ ID NO: 14371 - protein, 702 aa, Medicago truncatula
MELLPSSEKKGQKRKLEQQEEQFQQVTQISLPLTGDALDAVLSDVDQHVSILLSSFSSNEFDRASAKRATHALADLAKNEEIVNVIVEGGAVPALIKHLQPPTQNDSVQKPLPFEHEVEKGSAFALGLLAVKPEHQQLIVDSGALKHLVDLLKRHKNGLTSRAINSLIRRAADAITNLAHENSSIKTRVRTEGGIPPLVHLLEFADTKVQRAAAGALRTLAFKNDENKNQIVECNALPTLILMLRSEDAAIHYEAVGVIGNLVHSSPNIKKDVILAGALQPVIGLLSSCCSESQREAALLLGQFAATDSDCKVHIVQRGAVRPLIEMLQSSDVQLKEMSAFALGRLAQDTHNQAGIAHSGGLVPLLKLLDSKNGSLQHNAAFALYGLAENEDNVPDFIRIGGIKRFQDGEFIIQATKDCVAKTLKRLEEKINGRVLNHLLYLMRVSEKAFQRRVALALAHLCSADDQKKIFIDHNGLELLIGLLGSSCPKQQLDGAVALFKLANKAMTLSPVDAAPPSPTPQVYLGEQYVNNATLSDVTFLVEGKRFHAHRICLLASSDAFRAMFDGGYREKDARDIEIPNIRWQVFELMMRFIYTGSVDVTLEIAQDLLRAADQYLLEGLKRLCEYTIAQHVSLENVSSMYELSEAFNATSLRHTCILFILGHFDKLSETPGNSDLIQRTIPDIRNYFVNALTKGNSNIQA

SEQ ID NO: 14372 - protein, 704 aa, Medicago truncatula
MEFQRRQGHCLSERKGQKRKLDEELPEDRQISSAPPTADERAALLVEVANQVTVLESTFTWNEADRAAAKRATHALADLAKNEEVVNVIVEGGAIPALIKHLQAPPVTDCVQKPLPFEHEVEKGSAFALGLLAVKPEHQQLIVDGGALTHLVDLLKRHNNGLTSRAINSLIRRAADAVTNLAHENSNIKTHVRMEGGIPPLVHLLEFADTKVQRAAAGALRTLAFKNDENKIQIVECDALPTLILMLRSEDAAIHYEAVGVIGNLVHSSPNIKKEVLFAGALQPVIGLLSSRCPESQREAALLLGQFAATDSDCKVHIVQRGAVRPLIEMLSSPDVQLREMSAFALGRLAQDTHNQAGIAHNGGLVPLLKLLDSKNGSLQHNAAFALYGLAENEDNVSDFIRVGGVQRLQEGEFIVQATKDCVAKTLKRLEEKIHGRVLNHLLYLMRVSERGFQRRIALVLAHLCPADDQRRIFIEHHGLELLISLLSSSSSKQQLDGAVALCKLANKASALSPVDAAPPSPTPQVYLGEQYVNNATLSDVTFLVEGKRFYAHRICLLASSDAFRAMFDGGYREKDARDIEIPNIRWEVFELMMRFIYTGSVDITPDIAQDLLRAADQYLLDGLKRLCEYTIAQDILLENVSSMYELSEAFNALSLRHACILFILEHFDKLSARPGHSLLIQRIIPEIRNYFVKALTNVNSHRL

SEQ ID NO: 14373 - protein, 705 aa, Vitis vinifera
MELQKRQDQGQPERKGQKRKLEEEFEEEREISVAPSGEAHQALSCEVSAQVNILNTTFSWKEADRAAAKRATHVLAELAKNEEVVNVIVDGGAVPALVKHLQAPPSSDGDHDQRPFEHEVEKGSAFALGLLAVKPEHQQLIVDNGALSHLVDLLKRHRDGSNSRAVNSVIRRAADAVTNLAHENSSIKTRVRMEGGIPPLVQLLEFADTKVQRAAAGALRTLAFKNDENKNQIVECNALPTLILMLRSEDAAIHYEAVGVIGNLVHSSPNIKKEVLLAGALQPVIGLLSSCCSESQREAALLLGQFAATDSDCKVHIAQRGAVRPLIEMLQSADVQLREMSAFALGRLAQDTHNQAGIAHNGGLVPLLKLLDSKNGSLQHNAAFALYGLADNEDNVSDFIKVGGVQKLQDGEFIVQATKDCVAKTLKRLEEKIHGRVLNHLLYLMRVSEKAVQRRVALALAHLCSADDQRTIFIDNNGLELLLGLLGSSSPKQQLDGSVALYKLANKAMTLSPVDAAPPSPTPQVYLGEQYVNSATLSDVTFLVGGKRFYAHRICLLASSDAFRAMFDGGYREKDARDIEIPNIRWEVFELMMRFIYTGSVEITLDIAQDLLRAADQYLLEGLKRLCEYTIAQDISLENVSSMYELSEAFHAISLRHTCILFILEQFSKLSSRPGHSHLIQRIIPEIRTYFAKALTKPNPHNSRL

SEQ ID NO: 14374 - protein, 703 aa, Citrullus lanatus
MELQKRLDHSLPERKGHKRKLEEEFEEEREISVPTGDAKQALLTEVSDQVEILNSTFSWKEADRAAAKRATHVLAELAKNEEVVNVIVEGGAVPALVKHLQAPPTVEGDRSLKPFEHEVEKGSAFALGLLAVKPEHQQLIVDIGALSHLVELLKRHKDGSSRAVNSVIRRAADAITNLAHENSFIKTRVRMEGGIPPLVELLEFTDTKVQRAAAGALRTLAFKNDENKNQIVECNALPTLILMLRSEDAAIHYEAVGVIGNLVHSSPNIKREVLLAGALQPVIGLLSSCCSESQREAALLLGQFAATDSDCKIHIVQRGAVRPLIEMLQSPDVQLREMSAFALGRLAQETHNQAGIAHNGGLMPLLKLLDSKNGSLQHNAAFALYGLADNEDNVSDFIRVGGVQKLQDGEFIVQATKDCVAKTLKRLEEKIHGRVLNHLLHLMRVAEKAVQRRVSLALAHLCSPDDQRTIFIDNNGLELLLGLLGSSSLKQQLDGAVALYKLANKATTLSPVDAAPPSPTPQVYLGEQYVNNPTLSDVTFLVEGRRFHAHRICLLASSDAFRAMFDGGYREKDAKDIEIPNIRWEVFELMMRFVYTGSVDVLLDIAQDLLRAADQYLLEGLKRLCEYTIAQDISLENVSSMYELSEAFNAISLRHTCILFILEQFEKLSGMPGHSLLIQRILPEIRNYFAKALTKANLQSSRL

SEQ ID NO: 14375 - protein, 704 aa, Gossypium hirsutum
MELQRSEDQGLPERKGQKRKLEEEIQEDREISLPTGDARRALLAEVTAQVTVLESAFTWRESDRSAAKRATHVLAELAKNEEVVNVIVEGGAVPALVKHLQAPPCEDGDRSPKPFEHEVEKGSAFALGLLAVKPEHQQLIVDSGALSHLVNLLRRHKDSSISRAVISVIRRAADALTNLAHENSSIKTRVRMEGGIPPLVELLEFTDTKVQRAAAGALRTLAFKNDENKNQIVECNALPTLILMLRSEDAAIHYEAVGVIGNLVHSSPNIKKEVLAAGALQPVIGLLNSCCSESQREAALLLGQFAATDSDCKVHIVQRGAVRPLIEMLHSPDVQLKEMSTFALGRLAQDTHNQAGIAHSGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVALALAYLCSPDDQRTIFIDNNGLELLLGLLGSTSTKQQLDGAVALYKLSNKAMTLSPMDAAPPSPTPQVYLGEQYVNNATLSDVTFLVEGRRFYAHRICLLASSDAFRAMFDGGYREKDARDIEIPNIKWEVFELMMRFIYTGSVDVTLDIAQDLLRAADQYLLEGLKRLCEYTIAQDISLENVSSMYELSEAFHAISLRHTCILFILEHFDKLSARPGHLHLIQRIVPEIRNYFAKALTKPNPHKLRL

SEQ ID NO: 14376 - protein, 704 aa, Gossypium raimondii
MELQRSEDQGLPERKGQKRKLEEEIQEDREISLPTGAARRALLAEVTAQVTVLESAFTWRESDRSAAKRATHVLAELAKNEEVVNVIVEGGAVPALVKHLQAPPCEDGDRSPKPFEHEVEKGSAFALGLLAVKPEHQQLIVDSGALSHLVNLLRRHKDSSISRAVISVIRRAADALTNLAHENSSIKTRVRMEGGIPPLVELLEFTDTKVQRAAAGALRTLAFKNDENKNQIVECNALPTLILMLRSEDAAIHYEAVGVIGNLVHSSPNIKKEVLAAGALQPVIGLLNSCCSESQREAALLLGQFAATDSDCKVHIVQRGAVRPLIEMLHSPDVQLKEMSTFALGRLAQDTHNQAGIAHSGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVALALAYLCSPDDQRTIFIDNNGLELLLGLLGSTSTKQQLDGAVALYKLSNKAMTLSPMDAAPPSPTPQVYLGEQYVNNATLSDVTFLVEGRRFYAHRICLLASSDAFRAMFDGGYREKDARDIEIPNIKWEVFELMMRFIYTGSVDVTLDIAQDLLRAADQYLLEGLKRLCEYTIAQDISLENVSSMYELSEAFHAISLRHTCILFILEHFDKLSARPGHLHLIQRTVPEIRNYFAKALTKPNPHKLRL

SEQ ID NO: 14377 - protein, 705 aa, Gossypium hirsutum
MELQRCEEQGLQERKGQKRKLEEEIQEDRDATPLPTGDARRALLAEVTAQVKVLDSAFSWHESDRAAAKRATHVLAELAKNEEVVNVIVEGGAIPALVKHLQAPLSDEGDLSLKPFEHEVEKGSAFALGLLAVKPEHQQLIVDSGALSHLVNLLRRHKDSSTSRAVISVIRRAADAITNLAHENSSIKTRVRMEGGIPPLVELLEFTDTKVQRAAAGALRTLAFKNDENKNQIVECNALPTLISMLRSDDAAIHYEAVGVIGNLVHSSPNIKKEVLAAGALQPVIGLLTSCCSESQREAALLLGQFAATDSDCKVHIVQRGAVRPLIEMLHSPDIQLKEMSAFALGRLAQDTHNQAGIAHMGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVAFALAHLCSPDDQRTIFIDNNGLELLLGLLGSTNPKQQLDGAVALYKLANKAMTLSPMDAAPPSPTPQVYLGEQYVNNATLSDVTFLVEGRRFYAHRICLLASSDAFRAMFDGGYREKDARDIEIPNIRWEVFELMMRFIYTGSVDVSLDIAQDLLGAADQYLLEGLKRLCEYTIAQDVTLDNVSSMYELSEAFHAISLRHTCILFILEHFSQLSDRPGHSHLIQRIIPEIRNYFAKALTNPNPHNQRP

SEQ ID NO: 14378 - protein, 704 aa, Gossypium raimondii
MELQRSEDQGLPERKGQKRKLEEEIQEDREISLPTGAARRALLAEVTAQVTVLESAFTWRESDRSAAKRATHVLAELAKNEEVVNVIVEGGAVPALVKHLQAPPCEDGDRSPKPFEHEVEKGSAFALGLLAVKPEHQQLIVDSGALSHLVNLLRRHKDSSISRAVISVIRRAADALTNLAHENSSIKTRVRMEGGIPPLVELLEFTDTKVQRAAAGALRTLAFKNDENKNQIVECNALPTLILMLRSEDAAIHYEAVGVIGNLVHSSPNIKKEVLAAGALQPVIGLLNSCCSESQREAALLLGQFAATDSDCKVHIVQRGAVRPLIEMLHSPDVQLKEMSTFALGRLAQDTHNQAGIAHSGGLVPLLKLLDSKNGSLQHNAAFALYGLADNEDNVSDFIRVGGVQRLQDGEFIVQATKDCVAKTLKRLEEKIHGRVLNHLLYLMRIAEKPVQRRVALALAYLCSPDDQRTIFIDNNGLELLLGLLGSTSTKQQLDGAVALYKLSNKAMTLSPMDAAPPSPTPQVYLGEQYVNNATLSDVTFLVEGRRFYAHRICLLASSDAFRAMFDGGYREKDARDIEIPNIKWEVFELMMRFIYTGSVDVTLDIAQDLLRAADQYLLEGLKRLCEYTIAQDISLENVSSMYELSEAFHAISLRHTCILFILEHFDKLSARPGHLHLIQRIVPEIRNYFAKALTKPNPHKLRL

SEQ ID NO: 14379 - protein, 704 aa, Gossypium hirsutum
MELQRSEDQGLPERKGQKRKLEEEIQEDREISLPTGAARRALLAEVTAQVTVLESAFTWRESDRSAAKRATHVLAELAKNEEVVNVIVEGGAVPALVKHLQAPPCEDRDRSPKPFEHEVEKGSAFALGLLAVKPEHQQLIVDSGALSHLVNLLRRYKDSSISRAVISVIRRAADALTNLAHENSSIKTRVRMEGGIPPLVELLEFTDTKVQRAAAGALRTLAFKNDENKNQIVECNALPTLILMLRSEDAAIHYEAVGVIGNLVHSSPNIKREVLAAGALQPVIGLLNSCCSESQREAALLLGQFAATDSDCKVHIVQRGAVRPLIEMLHSPDVQLKEMSTFALGRLAQDTHNQAGIAHSGGLVPLLKLLDSKNGSLQHNAAFALYGLADNEDNVSDFIRVGGVQRLQDGEFIVQATKDCVAKTLKRLEEKIHGRVLNHLLYLMRIAEKPVQRRVALALAYLCSPDDQRTIFIDNNGLELLLGLLGSTSTKQQLDGAVALYKLSNKAMTLSPMDAAPPSPTPQVYLGEQYVNNATLSDVTFLVEGRRFYAHRICLLASSDAFRAMFDGGYREKDARDIEIPNIKWEVFELMMRFIYTGSVDVTLDIAQDLLRAADQYLLEGLKRLCEYTIAQDISLENVSSMYELSEAFHAISLRHTCILFILEHFDKLSARPGHLHLIQRIVPEIRNYFAKALTKPNPHKLRL

SEQ ID NO: 14380 - protein, 705 aa, Gossypium raimondii
MELQRCEEQGLQERKGQKRKLEEEIQEDRDATPLPTGDARRALLAEVTAQVKVLDCAFSWHESDRAAAKRATHVLAELAKNEEVVNVIVEGGAIPALVKHLQAPLSDEGDLSLKPFEHEVEKGSAFALGLLAVKPEHQQLIVDSGALSHLVNLLRRYKDSSTSRAVISVIRRAADAITNLAHENSSIKTRVRMEGGIPPLVELLEFTDTKVQRAAAGALRTLAFKNDENKNQIVECNALPTLISMLRSDDAAIHYEAVGVIGNLVHSSPNIKKEVLAAGALQPVIGLLTSCCSESQREAALLLGQFAATDSDCKVHIVQRGAVRPLIEMLHSPDIQLKEMSAFALGRLAQDTHNQAGIAHMGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVAFALAHLCSPDDQRTIFIDNNGLELLLGLLGSTNPKQQLDGAVALYKLANKAMTLSPMDAAPPSPTPQVYLGEQYVNNATLSDVTFLVEGRRFYAHRICLLASSDAFRAMFDGGYREKDARDIEIPNIRWEVFELMMRFIYTGSVDVSLDIAQDLLGAADQYLLEGLKRLCEYTIAQDVTLDNVSSMYELSEAFHAISLRHTCILFILEHFSQLSDRPGHSHLIQRIIPEIRNYFAKALTNPNPHNQRL

SEQ ID NO: 14381 - protein, 705 aa, Gossypium raimondii
MELQRCEEQGLQERKGQKRKLEEEIQEDRDATPLPTGDARRALLAEVTAQVKVLDCAFSWHESDRAAVKRATHVLAELAKNEEVVNVIVEGGAIPALVKHLQAPLSDEGDLSLKPFEHEVEKGSAFALGLLAVKPEHQQLIVDSGALSHLVNLLRRYKDSSTSRAVISVIRRAADAITNLAHENSSIKTRVRMEGGIPPLVELLEFTDTKVQRAAAGALRTLAFKNDENKNQIVECNALPTLISMLRSDDAAIHYEAVGVIGNLVHSSPNIKREVLAAGALQPVIGLLTSCCSESQREAALLLGQFAATDSDCKVHIVQRGAVRPLIEMLHSPDIQLKEMSAFALGRLAQDTHNQAGIAHMGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVAFALAHLCSPDDQRTIFIDNNGLELLLGLLGSTNPKQQLDGAVALYKLANKAMTLSPMDAAPPSPTPQVYLGEQYVNNATLSDVTFLVEGRRFYAHRICLLASSDAFRAMFDGGYREKDARDIEIPNIRWEVFELMMRFIYTGSVDVSLDIAQDLLGAADQYLLEGLKRLCEYTIAQDVTLDNVSSMYELSEAFHAISLRHTCILFILEHFSQLSDRPGHSHLIQRIIPEIRNYFAKALTNPNPHNQRP

SEQ ID NO: 14382 - protein, 499 aa, Manihot esculenta
MEPQRSQQDQGLPERKGQKRKLEEEIEEEQREISPAATFGDARQALLHEVAAQVNILNSTFSWNEADRAAVKRATHVLAEFAKNEELVNVIVEGGAVPALVKHLQAPQSGEADRNSKPFEHEVEKGSAFALGLLAVKPEHQQLIVDAGALSLLVDLLKRHKDGSISRAVNSVIRRAADAITNLAHENSSIKTRVRMEGGIPPLVELLEFTDTKVQRAAAGALRTLAFKNDENKKQIVECNALPTLILMLRSEDAAIHYEAVGVIGNLVHSSPNIKKEVLAAGALQPVIGLLSSCCSESQREAALLLGQFAATDSDCKVHIVQRGAVQPLIEMLQSPDLQLREMSAFALGRLAQDSHNQAGIAHNGGLVPLLKLLDSKNGSLQHNAAFALYGLADNEDNMSDFIRVGGVQKLQDGEFIVQATKDCVSKTLKRLEEKIHGRVLNHLLYLMRVAEKAVQRRVALALAHLCSPDDQRTIFIDNNGMIGVTSRASWLYKPEATD

SEQ ID NO: 14383 - protein, 705 aa, Cannabis sativa
MELQRRQDQYLPEKKGQKRKLEDEIEEDDPEISVPSGDVKQALLSDVGVQVNILNSAFSWSEADRAAAKRATHVLAELAKNEEVVNVIVEGGAVPALVKHLQAPPSLESDRGSKPYEHEVEKGCAFALGLLAVKPEHQQLIVDTGALSHLVDLLKRYKSGSISRAVNSVIRRAADAITNLAHENSSIKTRVRIEGGIPPLVELLDFTDTKVQRAAAGALRTLAFKNDENKNQIVECNALPTLILMLRSEDAAIHYEAVGVIGNLVHSSPNIKKEVLLAGALQPVIGLLSSCCSESQREAALLLGQFAATDSDCKVHIVQRGAVPPLIEMLQSPDVQLREMSAFALGRLAQDAHNQAGIAHNGGIVPLLKLLDSKIGSLQHNAAFALYGLADNEDNVSDFIRVGGVQKLQDGEFIVQATKDCVAKTLKRLEEKIHGRVLSHLLYLMRVGEKAVQRRVALALAHLCSPDDQRNIFIDSNGLELLIGILGSTSLKQQNDGAVALYKLANKALTLSPVDAAPPSPTPQVYLGEQYVNSPTLSDVTFLVEGRRFYAHRICLLASSDAFRAMFDGGYREKDARDIEIPNIRWEVFELMMRFVYTGSIEIAVDIAQDLLRAADQYLLEGLKRLCEYTIAQDISLENVSSMYELSEAFNAASLRHTCILFILQQFEKLSARPGHTHLVQRILPEIRIYFAKALTKPNLHNQRP

SEQ ID NO: 14384 - protein, 692 aa, Lupinus angustifolius
MERDPDEWLPERKGQKRKQLDQNDFHFPSQICISEQVSILNSTFSSNLSHRSAAKRATHLLADLAKNEEVVHDIVEGGAIPALVMHLQPPPLDQNDRFQKPLPFEHEVEKGSAFALGLLAVKPEHQQLIVDNGALKHLVDLLKRHDNVLTSRAVNSLIRRAADAITNLAHENSSIKTRVRMEGGIPPLVDLLEVADTKVQRAAAGALRTLAFKNDENKNEIVEYNALPTLILMLRSEDAAVHYEAVGVIGNLVHSSPNIKKEVLLAGALQPVIRLLSSCCSESQREAALLLGQFAATDSDCKVHIVQRGAVRPLIEMLQSPDVQLREMSAFALGRLAQDSHNQAGIAHDGGLMPLLKLLDSKNGSLQHNAAFALYGLADNEDNVSDFIRVGGIQRLQEGEFIVQATKDCVAKTLKRLEEKISGPVLNHLLQLMRDSEKAFQRRVALSLAHLCSAADQRKIFIDHHGLELLIGLLGSSSPKQQLDGAVALWKLANKAMTLSPIDAAPPSPTPQVYLGEQYVNNCSVSDVTFLVEGKRFYAHRICLLASSDAFRAMFDGGYREKDARDIEIPNIRWEVFELMMRFIYTGSVDVTLHIAQDLLRAADQYLLEGLKRLCEYTIAQDISLENVSSMYELSEAFNAISLRHTCILFILEQFDKLSARQGHSLLIQRVMPEIRNYFVKALTKTNSRIQP

SEQ ID NO: 14385 - protein, 705 aa, Gossypium hirsutum
MELQRCEEQGLQERKGQKRKLEEEIQEDRDATPLPTGDARRALLAEVTAQVKVLDCAFSWHESDRAAAKRATHVLAELAKNEEVVNVVVEGGAIPALVKHLQAPLSDEGDLSLKPFEHEVEKGSAFALGLLAVKPEHQQLIVDSGALSHLVNLLRRYKDSSTSRAVISVIRRAADAITNLAHENSSIKTRVRMEGGIPPLVELLEFTDTKVQRAAAGALRTLAFKNDENKNQIVECNALPTLISMLRSDDAAIHYEAVGVIGNLVHSSPNIKREVLAAGALQPVIGLLTSCCSESQREAALLLGQFAATDSDCKVHIVQRGAVRPLIEMLHSPDIQLKEMSAFALGRLAQDTHNQAGIAHMGGLVPLLKLLDSKNGSLQHNAAFALYGLADNEDNVSDFIRVGGVQRLQDGEFIVQATKDCVAKTLKRLEEKIHGRVLNHLLYLMRVAEKPVQRRVAFALAHLCSPDDQRTIFIDNNGLELLLGLLGSTNPKQQLDGAVALYKLANKAMTLSPMDAAPPSPTPQVYLGEQYVNNATLSDVTFLVEGRRFYAHRICLLASSDAFRAMFDGGYREKDARDIEIPNIRWEVFELMMRFIYTGSVDVSLDIAQDLLGAADQYLLEGLKRLCEYTIAQDVTLDNVSSMYELSEAFHAISLRHTCILFILEHFSQLSDRPGHSHLIQRIVPEIRNYFAKALTNPNPHNQRL

SEQ ID NO: 14386 - protein, 719 aa, Ricinus communis
MEPQRSQSKDQGRPERKGQKRKLEEEIEDEQQEISASATAAAAAAVPFGDARQALLYEVASQVNILNSTFSWNEADRAAAKRAIHVLAEFAKNEELVNVIVEGGAVPALVKHLQAPPSSSSEVDRSTKPFEHEVEKGSAFALGLLAVKPEHQQLIVDIGALSHLVELLKRHKDGSVSRAVNSVIRRAADAITNLAHENSSIKTRVRVEGGIPPLVELLEFVDTKVQRAAAGALRTLAFKNDENKKQIVECNALPTLILMLRSEDAAIHYEAVGVIGNLVHSSPNIKKEVLAAGALQPVIGLLSSCCSESQREAALLLGQFAATDSDCKVHIVQRGAVQPLIEMLQSPDVQLREMSAFALGRLAQDLHNQAGIAHNGGLVPLLKLLDSKNGSLQHNAAFALYGLADNEDNVSDFIRVGGVQKLQDGEFIVQATKDCVAKTLKRLEEKIHGRVLHHLLYLMRVTEKAVQRRVALALAHLCSPDDQRTIFIDNNGLELLLGLLGSTSPKQQLDGAVALYKLANKAATLSPVDAAPPSPTPQVYLGEQFVNNATLSDVTFLVEGRRFYAHRICLLASSDAFRAMFDGGYREKDARDIEIPNIRWEVFELMMRFIYTGSVDVSLDIAQDLLRAADQYLLEGLKRLCEYTIAQDISLENVASMYELSEAFHAISLRHTCILFILEQFDKLNAKPRHSNLIQRIIPEIRNYFAKALTKPNPHNSRL

SEQ ID NO: 14387 - protein, 706 aa, Euphorbia peplus
EPQRNQDQGLPERKGRKRKLEEEIDDEHREISPALSFGDARQALLSEVSSQVNILNSSFSWNEPDRAAAKRATHVLAEFAKNEELVNVIVEGGAVPALVKHLQAPPLREDDRNPKAFEHEVEKGSAFALGLLAVKPEHQQLIVDNGALSHLVELLKRQKDGSISRAVNSVIRRAADAITNLAHENSSIKTRVRKEGGIPPLVELLEFIDSKVQRAAAGALRTLAFKNDENKKQIVEYNALPTLILMLRSEDTAIHYEAVGVIGNLVHSSPNIKKEVLAAGALQPVIGLLRSCCSESQREAALLLGQFAATDSDCKVHIVQRGAVQPLIDMLQSPDVQLREMSAFALGRLAQDSHNQAGIAHTGGLLPLLKLLDSKNGSLQHNAAFALYGLAENEDNVSDFIRVGGVQKLQDGEFIVQATKDCVSKTLKRLEEKIHGRVLSHLLYLMRVPDKAVQRRVALALAHLCSPDDQRTIFVENNGLELLLGLLGSTNPKQQLDGAVALFKLANKAMALSPVDAAPPSPTPQVYLGEQYVNSATLSDVTFLVEDRRFYAHRICLLASSDAFRAMFDGGYRERDARDIEIPNIRWEVFELMMRFIYTGSVDVSLDIAQDLLRAADQYLLEGLKRLCEYTIAQDISLENVASMYELSEAFHAISLRHTCILFILEQFDKLNAKPRHSHLIQRIVPEIRNYFAKALAKSNPHNLRL

SEQ ID NO: 14388 - protein, 486 aa, Manihot esculenta
MEPQRSQDQSLSERKGQKRKLEEEIEEKQREISAAVPFGDAREALLYEVTAQVNILNSTFSWNEADRAAAKRATHVLAEFAKNEELVNVIVEGGAVPALIKHLQAPYTNEADRNPKPFEHEVEKGSAFALGLLAVKPEHQQLIVDAGALSLLVDLLKRHKDGSSSRAVNSVIRRAADAITNLAHENSSIKTRVRVEGGIPPLVELLEFTDTKVQRAAAGALRTLAFKNDENKKQIVECNALPTLILMLRSEDAAIHYEAVGVIGNLVHSSPSIKKEVLAAGALQPVIGLLSSSCCSESQREAALLLGQFAATDSDCKVHIVQRGAVQPLIEMLQSPDVQLREMSAFALGRLAQDSHNQAGIAHNGGLVPLLKLLDSKNGSLQHNAAFALYGLADNEDNVSDFIRVGGVQKLQDGEFIVQATKDCVSKTLKRLEEKIHGRVLNHLLYLMRVAEKAVQRRVALALAHLCSPDDQRTIFIDNNGMPYSS

SEQ ID NO: 14389 - protein, 481 aa, Cucumis sativus
MELQKRLDQNLPERKGHKRKLEEEFEEEREISVPTGDAKQAILTEVSDQVEILNSTFSWKEADRAAAKRATHVLAELAKNEEVVNVIVEGGAVPALVKHLQAPPTIEGDRSLKPFEHEVEKGSAFALGLLAVKPEHQQLIVDIGALSHLVELLKRHKDGSSRAVNSVIRRAADAITNLAHENSFIKTRVRMEGGIPPLVELLEFTDTKVQRAAAGALRTLAFKNDENKNQIVECNALPTLILMLRSEDAAIHYEAVGVIGNLVHSSPNIKREVLLAGALQPVIGLLSSCCSESQREAALLLGQFAATDSDCKIHIVQRGAVRPLIEMLQSPDVQLREMSAFALGRLAQETHNQAGIAHNGGLMPLLKLLDSKNGSLQHNAAFALYGLADNEDNVSDFIRVGGVQKLQDGEFIVQATKDCVAKTLKRLEEKIHGRKAVQRRVSLALAHLCSPDDQRTIFIDNNGMSRVASWPTWFFKSQAAA

SEQ ID NO: 14390 - protein, 717 aa, Unknown
  Sequence found in Organisms: Citrus clementina, Citrus sinensis
MDPQRRQGPSVPERKGQKRKLDEETVIGDEQQQMQQREISSSSAGTSSSDARQALLSEVSAQVNVLNTTFSWLEADRAAAKRATHVLAELAKNEEVVNWIVEGGAVPALVKHLQAPPTSEADRNLKPFEHEVEKGSAFALGLLAVKPEHQQLIVDNGALSHLVNLLKRHMDSNCSRAVNSVIRRAADAITNLAHENSSIKTRVRMEGGIPPLVELLEFTDTKVQRAAAGALRTLAFKNDENKNQIVECNALPTLILMLRSEDSAIHYEAVGVIGNLVHSSPNIKKEVLAAGALQPVIGLLSSCCSESQREAALLLGQFAATDSDCKVHIVQRGAVRPLIEMLQSPDVQLREMSAFALGRLAQDMHNQAGIAHNGGLVPLLKLLDSKNGSLQHNAAFALYGLADNEDNVADFIRVGGVQKLQDGEFIVQATKDCVAKTLKRLEEKIHGRVLNHLLYLMRVAEKGVQRRVALALAHLCSPDDQRTIFIDGGGLELLLGLLGSTNPKQQLDGAVALFKLANKATTLSSVDAAPPSPTPQVYLGDQFVNNATLSDVTFLVEGRRFYAHRICLLASSDAFRAMFDGGYREKDARDIEIPNIRWEVFELMMRFIYTGSVDVTLDIAQDLLRAADQYLLEGLKRLCEYTIAQDISLENVSSMYELSEAFHAISLRHTCILYIMEHFDKLSTRPGHSNLIQRIIPEIHNYFAKALTKPNPHNSRL

SEQ ID NO: 14391 - protein, 704 aa, Malus domestica
MELQRGQDQSRPERKGQKRKLEEETGGEREISVKSGEARKALLSEVSEQVKVLNSTFSWSEADRASAKRATHVLAEIAKNEEVVNVIVEGGAVPSLVKHLQAPPLSDGDRSSKPFEHEVEKGSAFALGLLAVKPEHQQLIVDTGALAHLVDLLKRHKDSPVSRALYSVIRRAADAITNLAHENSSIKTRVRMEGGIPPLVELLEFADTKVQRAAAGALRTLAFKNDENKNQIVECNALPTLILMLRSEDAAIHYEAVGVIGNLVHSSPNIKKEVLLAGALQPVIGLLSSCCSESQREAALLIGQFAATDSDCKVHIVQRGAIQPLIEMLQSPDVQLREMSAFALGRLAQDTNNQAGIAHNGALVPLLKLLDSKNGSLQHNAAFTLYGLADNEDNVSDYIRIGGVQKLQDGEFIFQATKDCVTKTLKRLEEKIRGRVLSHLLYLMRVAERAVQRRVALAFAHLCSPDDLRTIFIDNNGLELLLGLLGSSTHKQQLDGATALYKLANKAMTLSPVDAAPPSPTPQVYLGEQYVNNPTLSDVIFLVEGKRFYAHRICLLASSDAFRAMFDGGYREKDARDIEIPNIRWEVFELMMRFIYTGSVDITLDIAQDLLRAADQYLLEGLKRLCEYTIAQDISLENVSNMYELSEAFHGMSLRHTCILFILEQFEKLSARPGHSHLIMRILPEISTYFTKALTKPNPHSLRL

SEQ ID NO: 14392 - protein, 715 aa, Prunus persica
MELQRRQDQNHPERKGQKRKLEEEIGDEREISVKSGEARKALLSEVSEQVKVLNSTFSWSEADRASAKRATHVLAELAKNEEVVNVIVEGGAVPALVKHLQAPPLSEGDRSSKPYEHEVEKGSAFALGLLAVKPEHQQLIVDTGALAHLVDLLKRHKDSPVSRALYSVIRRAADAITNLAHENSSIKTRVRIEGGIPPLVELLEFADTKVQRAAAGALRTLAFKNDENKNQIVECNALPTLILMLRSEDAAIHYEAVGVIGNLVHSSPNIKKEVLLAGALQPVIGLLSSCCSESQREAALLLGQFAATDSDCKVHIVQRGAVRPLIEMLQSPDVQLREMSAFALGRLAQDTNNQAGIAHNGGLLPLLKLLDSKNGSLQHNAAFTLYGLADNEDNVSDFIRVGGVQKLQDGEFIFQATKDCVTKTLKRLEEKIHGRVLSHLLYLMRVAERVVQKRVALAFAHLCSPDDLRTIFIDNNGINLYCLYIYVGLELLLGLLGSTAHKQQLDAAMALYKLANKAMTLSPVDAAPPSPTPQVYLGEQYVNNPTLSDVIFLVEGRRFYAHRICLLASSDAFRAMFDGGYREKDARDIEIPNIRWEVFELMMRFIYTGSVDITLDIAQDLLRAADQYLLEGLKRLCEYTIAQDVSLENVSNMYELSEAFHAMSLRHTCILFILEQFEKLSARPGHSHLIMRIIPEICTYFTKALTKPNPHNLRL

SEQ ID NO: 14393 - protein, 709 aa, Malus domestica
MELQRRQDQRRPERKGQKRKLEEETGGEREISVKSGEARKALLSEVSEQVKVLNSTFSWSEADRASAKRATHVLAELAKNEEVVSVIVEGGAVPALVKHLQAPPLSDGDGSSKPFEHEVEKGSAFALGLLAVKPEHQQLIVDTGALAHLVDLLKRHKDSPVSRALYSVIRRAADAITNLAHENSNIKTRVRIEGGIPPLVELLEFADTKVQRAAAGALRTLAFKNDENKNQIVECNALPTLILMLRSEDAAIHYEAVGVIGNLVHSSPIIKKEVLLAGALQPVIGLLSSCCSESQREAALLLGQFAATDSDCKVHIVQRGAVRPLIEMLQSPDVQLKEMSAFALGRLAQDSNNQAGIAHNGGLVPLLKLLDSKNGSLQHNAAFTLYGLADNEDNVSDYIRVGGVQKLQEGEFIFQATKDCVTKTLKRLEEKIHGRVLSHLLYLMRVAERAVQRRVALAFAHLCSPDDLRTVFIDNNGMSHPRLELLLGLLGSSAHKQQLDGATALYKLANKAMTLSPVDAAPPSPTPQVYLGEQYVNNPTLSDVIFLVEGRRFYAHRICLLASSDAFRAMFDGGYREKDARDIEIPNIRWEVFELMMRFIYTGSVDITIDIAQDLLRAADQYLLEGLKRLCEYTIAQDISLDNVSNMYELSEAFHAMSLRHTCILFILEQFDKLSARPGNSHLIMRILPEIRTYFTKALTKPNPHSLRL

SEQ ID NO: 14394 - protein, 717 aa, Prunus mume
MELQRRQDQNHPERKGQKRKLEEEIGDEREISVKSGEARKALLSEVSEQVKVLNSTFSWSEADRASAKRATHVLAELAKNEEVVNVIVEGGAVPALVKHLQAPPLSEGDRSSKPYEHEVEKGSAFALGLLAVKPEHQQLIVDTGALAHLVDLLKRHKDIPVSRALYSVIRRAADAITNLAHENSSIKTRVRIEGGIPPLVELLEFADTKVQRAAAGALRTLAFKNDENKNQIVECNALPTLILMLRSEDPAIHYEAVGVIGNLVHSSPNIKKEVLLAGALQPVIGLLSSCCSESQREAALLLGQFAATDSDCKVHIVQRGAVRPLIEMLQSPDVQLREMSAFALGRLAQDTNNQAGIAHNGGLLPLLKLLDSKNGSLQHNAAFTLYGLADNEDNVSDFIRVGGVQKLQDGEFIFQATKDCVTKTLKRLEEKIHGRVLSHLLYLMRVAERVVQKRVALAFAHLCSPDDLRTIFIDNNGMSHPLYLNHTFHGLELLLGLLGSTTHKQQLDAAMALYKLANKAMTLSPVDAAPPSPTPQVYLGEQYVNNPTLSDVIFLVEGRRFYAHRICLLASSDAFRAMFDGGYREKDARDIEIPNIRWEVFELMMRFIYTGSVDITLDIAQDLLRAADQYLLEGLKRLCEYTIAQDVSLENVSNMYELSEAFHAMSLRHTCILFILEQFEKLSARPGHSHLIMRIIPEICTYFTKALTKPNPHNLRL

SEQ ID NO: 14395 - protein, 708 aa, Fragaria vesca
MELPRRQDQSQSERKGQKRKLEEEIGEITTAHSGDDARKAILVQVAEQVKLLDSSFSWSEADRHAAKRATHVLAELAKNEDVVNVIVEGGAVPALVKHLQAPPRSEVDRSSTKHCEHEVEKGSAFALGLLAVKPEHQQLIVDNGALSHLVDLLKRRTDSHVNRPLNSVIRRAADAITNLAHENSSIKTRVRIEGGIPPLVELLEFADTKVQRAAAGALRTLAFKNDENKNQIVECNALPTLILMLRSEDAAIHYEAVGVIGNLVHSSPNIKKEVLLAGALQPVIGLLSSCCFESQREAALLLGQFAATDSDCKVHIVQRGAVRPLIEMLQSSDVQLREMSAFALGRLAQDSHNQAGIVHNGGLKPLLNLLDSKNGSLQHNAAFTLYGLADNEDNVSDFIRNGGVQKLQDGEFIFQATKDCVTKTLKRLEEKIHGRVLSHLLYLMRVGERNVSKCVALAFAHLCSPEDLRTIFIDNNGMSLCLELLLGLLGSIKPKQQLDGATALYKLANKAMTLSPVDAAPPSPTPQVYLGEQYVNNPTLSDVTFLVEGKRFYAHRICLLASSDAFRAMFDGGYREKDARDIEIPNIRWEVFELMMRFIYTGSVDITLDIAQDLLRAADQYLLEGLKRLCEYSIAQDISLENVSNMYELSEAFHAMSLRQTCILFVLEQFEKLSARPGHSELIKDMLKEIRTYFTKALTMPNPHNLRL

SEQ ID NO: 14396 - protein, 717 aa, Populus trichocarpa
MELKKHQDQRVPERKGQKRKLEEEIEEGKREISAAEAAAAAPYGEARRVILNEVYTQVNILNSTFSWHETHRGAAKRATHILAELAKNEEVVNVIVEGGAVPALVKHLEAPPSSEIDHNNSKPFEHEVEKESAFALGLLAVKPEHQQIIVDAGALSHLVSLLKRQRDVHRDGSNSRAVNSVIRRAADAITNLAHENSSIKTRVRMEGGIPPLVELLEFTDTKVQRAAAGALRTLAFKNDENKNQIVECYALPTLILMLRSDDAAIHYEAVGVIGNLVHSSPNIKREVLAAGALQPVIGLLSSCCSESQREAALLLGQFAATDSDCKVHIVQRGAVRPLIEMLQSPDVQLREMSAFALGRLAQDTHNQAGIAHNGGLVPLLKLLDSKNGSLQHNAAFALYGLADNEDNVSDFISVGGVQKLQDGEFIVQATKDCVAKTLKRLEEKIHGRVLNHLLYLMRVAEKAVQRRVALALAHLCSPDDQRAIFIDNCGLDLLLGLLGSSSLKQQLDGAIALYRLANKATTLSPVDAAPPSPTPQVYLGEQYVNNPTLSDVTFLVEGRRFYAHRICLLASSDAFRAMFDGGYREKDARDIEIPNIRWEVFELMMRFIYTGSVDVTLIIAQDLLRAADQYLLEGLKRLCEYTIAQDITLENIGSMYELSEAFHAISLRHRCILFILEQFDKLSDKPRHSQLIQRIIPEIRNYFEKALTNPHQHNSRL

SEQ ID NO: 14397 - protein, 717 aa, Populus trichocarpa
MELKKHQDQRLPERKGQKRKLEEEIEEEQREISAVEEAAAAPYGEARKVILNEVYAQVNILNSTFSWDEAHRATAKRATHVLAELAKNEEVVNLIVEGGAVPALVKHLQVPPSSEIDHDNSKPFEHEVEKGSAFALGLLAVKPEHQQLIVDAGALSHLVSLLKRQRDVHKDGSDSRAVNSVIRRAADAITNLAHENSSIKTRVRMEGGIPPLVELLEFTDTKVQRAAAGALRTLAFKNDENKNQIVECNALPALILMLRSDAAAIHYEAVGVIGNLVHSSPSIKREVLAAGALQPVIGLLSSCCSESQREAALLLGQFAATDSDCKVHIVQRGAVQPLIEMLQSPDVQLREMSAFALGRLAQDTHNQAGIAHNGGLVPLLKLLDSKNGSLQHNAAFSLYGLADNEDNVSDFISVGGVQKLQDGEFSVQATKDCVAKTLKRLEEKIHGRVLNHLLYLMRVAEKAVQRRVALALAHLCSPDDQRAIFINNSGLDLLLGLLGSSSPKQQLDGAIALYRLANKATILSPVDAAPPSPTPQVYLGEQYVNNATLSDVTFLVEGRRFYAHRICLLASSDAFRAMFDGGYREKDARDIEIPNIRWEVFELMMRFIYTGSVDVTLGIAQDLLRAADQYLLEGLKRLCEYTIAQDITLENISSMYELSEAFHAISLRHRCILFILEQFDKLSDKPRHSQLIHRIIPEIRDYFDKALTKPNQHNSRL

SEQ ID NO: 14398 - protein, 708 aa, Panax ginseng
MDFQKRHDKVNKPERKGQKRKLLHEEFDGDRQISVPSASFSGDSHRSLLCEVAAQVNTLNSTFSWNEADRAAAKHATHVLAELAKNEEIVNVIVDGGAVPALVKHLEGPPSSEGEIKPFEHEVEKGSAFALGLLAVKPEHQQLIVDTGALPHLVNLLNRHKDGPVSRAVNSVIRRAADAITNLAHENSSIKTRVRLEGGIPPLVELLEFSDPKVQRATAGALRTLAFKNEENKNQIFECSALPTLILMLRSQDAAIHYEAVGVIGNLVHSSPSIKKEVLLAGALQPVIGLLSSCCSESQREAALLLGQFAATDSDCKVHIVQRGAVRPLIEMLQSPDVQLREMSAFALGRLAQDMHNQAGIAHSGGLVPLLKLLDSKNGSLQHNAAFALYGLADNEDNVSDFIKVGGIQKLQDGEFIVQATKDCVAKTLKRLEEKIHGRVLNHLLYLMRVAEKGIQRRVALALAHLCSPEDQRIIFIDNNGLELLLALLGSTSLKQQLDGSVAMYKLANKALSLSPDDAAPPSPTPQVYLGEQYVNNSTLSDVTFLVEGKRFYAHRICLLASSDAFRAMFDGGYREKDARDVEIPNIRWEVFELMMRFIYTGSVDVSLDIAQDLLSAADQYLLEGLKRLCEYTIAQDISLENVSSMYELSEAFHAVSLRHTCILFLLEHFDKLNARPGFSHLIQRLIPEIRNYFYSALTRPSTHSLRL

SEQ ID NO: 14399 - protein, 709 aa, Panax ginseng
MDFQKRHDKVNRPERKGQKRKLLHEEFDGDRQISVPSASFSGDSHRSLLCEVAAQVNTLNSTFSWNEADRAAAKHATHVLAELAKNEEIVNVIVDGGAVPALVKHLEGPPSSEGEIKPFEHEVEKGSAFALGLLAVKPEHQQLIVDTGALPHLVNLLNRHKDGSVSRAVNSVIRRAADAITNLAHENSSIKTRVRLEGGIPPLVELLEFSDPKVQRATAGALRTLAFKNEENKNQIFECSALPTLILMLRSQDAAIHYEAVGVIGNLVHSSPSIKKEVLLAGALQPVIGLLSSCCSESQREAALLLGQFAATDSDCKVHIVQRGAVRPLIEMLQSPDVQLREMSAFALGRLAQDMHNQAGIAHSGGLVPLLKLLDSKNGSLQHNAAFALYGLADNEDNVSDFIKVGGIQKLQDGEFIVQATKDCVAKTLKRLEEKIHGRVLNHLLYLMRVAEKGIQRRVALALAHLCSPEDQRIIFIDNNGLELLLALLGSTSLKQQLDGSVAMYKLANKALSLSPDDAAPPSPTPQVYLGEQYVNNSTLSDVTFLVEGKRFYAHRICLLASSDAFRAMFDGGYREKDARDVEIPNIRWEVFELMMRFIYTGSIDVSLDIAQDLLSAADQYLLEGLKRLCEYTIAQDISLENVSSMYELSEAFHAVSLRHTCILFILEHFDKLNASPGFSHLIQRLIPEIRNYFYSALTRPSTTHSLWL

SEQ ID NO: 14400 - protein, 389 aa, Quercus alba
MEEDNHPHHLRHHHHQDHNFPERKGQKRKLEVEDEIIEEEEEDERGGGGGGVGGEISGPPSGDAKQALLCEVAAQVTVLNSSFSWREPDRSAAKRATHVLAELAKNEEVVNVIVEGGAVPALVKHLQAPACSEGERSSKPYEHEVEKGSAFALGLLAVKPEHQQLIVDTGALSYLVDLLKRHKEGSSSRAVNSVIRRAADAITNLAHENSSIKTRVRMEGGIPPLVELLEFTDTKVQRAAAGALRTLAFKNDENKNQIVECNALPTLILMLRSEDTAIHYEAVGVIGNLVHSSPNIKKEVLQAGALQPVIGLLSSLCSESQREAALLLGQFAATDSDCKVHIVQRGAVKPLIEMLQSSDVQLREMSAFALGRTHTTKLVLLIMVVWCHY

SEQ ID NO: 14401 - protein, 670 aa, Euonymus alatus
SGDARQALLSEVVAHVKILNSAFSWNEADRAAAKRATHVLAELAKNEEVVNVIVEGGAVPALVKHLQSPPSGEDDRGLKPFEHEVEKGSAFALGLLAVKPEHQQLIVDNGSLLHLVDLLKRHKVGSCSRAVTSVIRRAADAITNLAHENSSIKTRVRLEGGIPPLVELLEFTDTKVQRAAAGALRTLAFKNDENKNQIVECNALPTLILMLRSEDAAIHYEAVGVIGNLVHSSPNIKKEVLNAGALQPVIGLLSSSCSESQREAALLLGQFAATDSDCKVHIVQRGAVGPLIDMLQSQDVQLREMSAFALGRLAQDAHNQAGIVHNGGLGPLLKLLDSKNGSLQHNAAFALYGLADNKDNVSDFIRVGGVQKLQDGEFIVQATKDCVAKTLKRLEEKIHGRVLKHLLYLLRVAEKSVQRRVALALAHLCSPDDQRTIFIEKNGLELLLGLLGSTNSKQQLDGAVALYKMANKATTLSPVDAAPPSPTPQVYLGEQYVNNSTLSDVTFLVEGRRFYAHRICLLASSDAFRAMFDGGYREKDARDIEIPNIRWEVFELMMRFIYTGSVVVSLDIAQDLLRAADQYLLEGLKRLCEYTIAQDISLENVASMYELSEAFHAMSLRNTCILFILEQFSRLSQRPGHSHLMQRILPEIRDYFTKALTKPNSHSLLL

SEQ ID NO: 14402 - protein, 708 aa, Panax ginseng
MDFQKRHDKVNRPERKGQKRKLLHEEFDGDRQISVPSASFSGDSHRLLLCEVAAQVNILNSTFSWSEADRAAAKHATHVLAELAKNEEIVNVIVDGGAVPALVKHLEGPPSSEGEIKPFEHEVEKGSAFALGLLAVKPEHQQLIVDTGALPHLVNLLNRHKDGPVSRAVNSVIRRAADAITNLAHENSSIKTRVRLEGGIPPLVELLEFSDPKVQRATAGALRTLAFKNEENKNQIFECSALPTLILMLRSQDAAIHYEAVGVIGNLVHSSPSIKKEVLLAGALQPVIGLLSSCCSESQREAALLLGQFAATDSDCKVHIVQRGAVRPLIEMLQSPDVQLREMSAFALGRLAQDMHNQAGIAHSGGLVPLLKLLDSKNGSLQHNAAFALYGLADNEDNVSDFIKVGGIQKLQDGEFIVQATKDCVAKTLKRLEEKIHGRVLNHLLYLMRVAEKGIQRRVALALAHLCSPEDQRIIFIDNNGLELLLALLGSTSLKQQLDGSVAMYKLANKALSLSPDDAAPPSPTPQVYLGEQYVNNSTLSDVTFLVEGKRFYAHRICLLASSDAFRAMFDGGYREKDARDVEIPNIRWEVFELMMRFIYTGSIDVSLDIAQDLLSAADQYLLEGLKRLCEYSIAQDISLENVSSMYELSEAFHAVSLRHTCILFLLEHFDKLNARPGFSHLIQQLIPEIRNYFYSALTRPSTHSLRL

SEQ ID NO: 14403 - protein, 712 aa, Eucalyptus grandis
MDCNRSDDLQDIQEKKGQKRKLEDEAAAADSEISASAGGGGGGGDGGRQSLLSEVAAQVKVLESAFSWVETDRAAAKRATHVLAELAKNEELGSLLVEGGVVPALVKHLRAPPSAEGDRGVRPYEHEVEKGCAFALGHLAVKPELQQLIVDCGALPHLIDLLKRHKDGSTTRAVNSLIRRAADAITNLAHENSSIKIRVRMEGGIQPLVELLDFMDTKVQRAAAGALRTLAFKNDENKNQIVECNALPTLILMLRSEDAAIHYEAVGVIGNLVHSSPNIKKEVLSAGALQPVIGLLSSCCPESQREAALLLGQFAAADSDCKVHIVQRGAVRPLIDMLQSDDFQLREMSAFALGRLAQDAHNQAGIAYNGGLIPLLKLLDSKNGSLQHNAAFALYGLADNEDNVSDFIRVGGVQKLQDGEFIVQATKDCVAKTLKRLEEKIHGRVLNHLLYLMRIAEKTVQRRVALALAHLCSPDDQQTIFVDNNGLELLVGLLICSSARQQLDGAVALFKLANKAMSLSPVDAAPPSPTPQVYLGEQYVNNPTLSDVTFLVEGRRFYAHRICLLASSDAFRAMFDGGYREKDARDIEIPNIRWEVFELMMRFIYTGSIDVTLEIAQDLLRASDQYLLEGLKRLCEYSIAQDISLENVSSMYELSEAFNAISLRHSCILFILEHFDKLRPGNFPLIHRIIPEIQQYFVKALTKSNQRSTLRP

SEQ ID NO: 14404 - protein, 662 aa, Castanea mollissima
EVAAQVTVLNSSFSWREPDRSAAKRATHVLAELAKNEEVVNVIVEGGAVPALVKHLQAPAFSEGERSSKPYEHEVEKGSAFALGLLAVKPEHQQLIVDTGALSHLVDLLKRHKEGSSSRAVNSVIRRAADAITNLAHENSSIKTRVRMEGGIPPLVELLEFTDTKVQRAAAGALRTLAFKNDENKNQIVECNALPTLILMLRSEDTAIHYEAVGVIGNLVHSSPNIKKEVLQAGALQPVIGLLSSLCSESQREAALLLGQFAATDSDCKVHIVQRGAVKPLIEMLQSSDVQLREMSAFALGRLAQDTHNQAGIAHNGGLVPLLKLLDSKNGSLQHNAAFALYGLADNEDNVSDFIRVGGVQKLQDGEFIVQATKDCVAKTLKRLEEKIHGRVLNHLLYLMRVAEKTVQRRVALALAHLCSPDDQRTIFIDNNGLELLLGLLSSSSPKQQLDGAVALYRLSNKAMALSPVDAAPPSPTPQVYLGEQYVNNVTLSDVTFLVEGKRFYAHRICLLASSDAFRAMFDGGYREKDARDIEIPNIKWDVFELMMRFIYTGSVEVTLDIAQDLLRAADQYLLEGLKRLCEYSIARDISLENVSSMYELSEAFHAMSLRHTCILFILEQFDKLSDRAGHSHSHLIQRIIPEIRNYFAKALTKHNSHNLRL

SEQ ID NO: 14405 - protein, 322 aa, Theobroma cacao
MELQRSQDQGLPERKGQKRKLEEENQEDRETSLPTGDARRALLAEVTAQVSVLDSTFSWREPDRAAAKRATHVLAELAKNEEVVNVIVEGGAVPALVKHLQAPPCSDGDRSPKPFEHEVEKGSAFALGLLAVKPEHQQLIVDSGALSHLVNLLRRHKDGSTSRAVISVIRRAADAITNLAHENSSIKTRVRMEGGIPPLVELLDFTDTKVQRAAAGALRTLAFKNDENKNQIVECNALPSLILMLRSEDAAIHYEAVGVIGNLVHSSPNIKKEVLAAGALQPVIGLLTSCCSESQREAALLLGQFAATDSDCKLFVSFPLSL

SEQ ID NO: 14406 - protein, 461 aa, Panax ginseng
MLRSQDAAIHYEAVGVIGNLVHSSPSIKKEVLLAGALQPVIGLLSSCCSESQREAALLLGQFAATDTDCKVHIVQRGAVRPLIEMLQSPDVQLREMSAFALGRLAQDMHNQAGIAHSGGLVPLLKLLDSKNGSLQHNAAFALYGLADNEDNVSDFIKVGGIQKLQDGEFIVQATKDCVAKTLKRLEEKIHGRVLNHLLYLMRVAEKGIQRRVALALAHLCSPEDQRIIFIDNNGLELLLALLGSTSLKQQLDGSVAMYKLANKALSLSPDDAAPPSPTPQVYLGEQYVNNSTLSDVTFLVEGKRFYAHRICLLASSDAFRAMFDGGYREKDARDVEIPNIRWEVFELMMRFIYTGSIDVSLDIAQDLLSAADQYLLEGLKRLCEYSIAQDISLENVSSMYELSEAFHAVSLRHTCILFLLEHFDKLNARPGFSHLVQQLIPEIRNYFYSALTRPSTHSLRL

SEQ ID NO: 14407 - protein, 710 aa, Eutrema halophilum
MEQQPERREGRSFPERKGQKRKLEEGAAASEDREISATTTDGGHALLSEVAAQVSVLNSAFSWKESDRAAAKRATQVLAELAKNEDLVNVIVDGGAVPALMTHLQAPPYSDEEMAQKPFEHEVEKGSAFALGLLAIKPEYQKLIVDKGALPHLVNLLKRNKDGSCSRAVNSVIRRAADAITNLAHENSSIKTRVRLEGGIPPLVELLEFSDSKVQRAAAGALRTLAFKNDDNKNQIVECNALPTLILMLGSEDAAIHYEAVGVIGNLVHSSPNIKKEVLSAGALQPVIGLLSSCCPESQREAALLLGQFASTDSDCKVHIVQRGAVRPLIEMLQSPDVQLKEMSAFALGRLAQDSHNQAGIAHSGGLGPLLKLLDSRNGSLQHNAAFALYGLADNEDNVSDFIRVGGIQRLQDGEFIVQATKDCVSKTLKRLEEKIHGRVLRHLLYLMRISEKSIQRRVSLALAHLCSPEDQRTIFIDDNGLELLLGLLGSTNIKQQLDGAAALYKLANKSMALSPVDAAPPSPTQRVYLGEQYVNNATLSDVTFLVEGRTFYAHRICLLASSDAFRAMFDGGYREKDARDIEIPNIKWEVFELMMRFIYTGSVDITIEIAQDLLRAADQYLLEGLKRLCEYTIAQDITLENIGSMYDLSEAFHAMSLRQSCILFILEHFDKLSSMDGHNQLVQRTVPEIREYFCRALTKSTTNLQSLRL

SEQ ID NO: 14408 - protein, 710 aa, Arabidopsis thaliana
MDQQPERREGRSFPERKGQKRKLEEGAAAVEDREISAVSTDGGQALLSEVAAQVSVLNSAFSWQESDRAAAKRATQVLAELAKNEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDDNGLELLLGLLGSLNTKQQLDGAAALYKLANKSMALSPVDAAPPSPTQRVYLGEQYVNNATLSDVTFLVEGRTFYAHRICLLASSDAFRAMFDGGYREKDARDIEIPNIKWEVFELMMRFIYTGSVDITNEISKDLLRAADQYLLEGLKRLCEYTIAQDITLESIGDMYELSEAFHAMSLRQACIMFILEHFDKLSSMPWQNELVQRTIPEIREYFCRALTKSTTNLQSLRL

SEQ ID NO: 14409 - protein, 714 aa, Brassica napus
MEQQQPERREGRSFPERKGQKRKLEEGAAAAAEDREISASTTTDGGGDAILNEIAAQVSVLNSAFSWQESDRAAAKRATQVLAELAKNEDLVNVIVDGGAVPALMTHLQAPPYIDGDLAQKPFEHEVEKGSAFALGLLAIKPEYQKLIVDKGALPHLVNLLKRSKDGSTSRAVNSVIRRAADAITNLAHENSSIKTRVRLEGGIPPLVDLLEFSDSKVQRAAAGALRTLAFKNDDNKNQIVECSALPKLILMLGSEDAAIHYEAVGVIGNLVHSSPNIKKEVLSAGALQPVIGLLSSCCPESQREAALLLGQFASTDSDCKVHIVQRGAVRPLIEMLQSPDVQLKEMSAFALGRLAQDSHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDENGLELLLGLLGSTNTKQQLDGAAALYKLANKSMALSPVDAAPPSPTQRVYLGEQYVNSATLSDVTFLVEGRRFYAHRICLLASSDAFRAMFDGGYREKDARDIEIPNIKWEVFELMMRFIYTGSVDITIEISQDLLRAADQYLLEGLKRLCEYTIAQDITLENIGGMYDLSEAFHAMSLRQACILFILEHFDKLSTMHGQNQLVQRTIPEIREYFCRALTKSTTNLQGLRL

SEQ ID NO: 14410 - protein, 710 aa, Arabidopsis lyrata
MEQQPERREGRSFPERKGQKRKLEEGAAAVEDRQISAVTTDGGQALLTEVAAQVSVLNSAFSWQESDRAAAKRATQVLAELAKNEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLAAGALQPVIGLLSSCCPESQREAALLLGQFASTDSDCKVHIVQRGAVRPLIEMLQSPDVQLKEMSAFALGRLAQDTHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDDNGLELLLGLLGSLNTKQQLDGAAALYKLANKSMALSPVDSAPPSPTQRVYLGEQYVNNATLSDVTFLVEGRTFYAHRICLLASSDAFRAMFDGGYREKDARDIEIPNIKWEVFELMMRFIYTGSVDITNEISKDLLRAADQYLLEGLKRLCEYTIAQDITLESIGDMYELSEAFHAMSLRQACILFILEHFDKLSSMPWQNELVQRTIPEIREYFCRALTKSTTNLQSLRL

SEQ ID NO: 14411 - protein, 714 aa, Brassica rapa
MEQQQPERREGRSFPERKGQKRKLEEGAAAAAEDREISASTTTDGGGDAILNEIAAQVSVLNSAFSWQESDRAAAKRATQVLAELAKNEDLVNVIVDGGAVPALMTHLQAPPYSEGDLAQKPFEHEVEKGSAFALGLLAIKPEYQKLIVDKGALPHLVNLLKRSKDGSTSRAVNSVIRRAADAITNLAHENSSIKTRVRLEGGIPPLVDLLEFSDSKVQRAAAGALRTLAFKNDDNKNQIVECSALPKLILMLGSEDAAIHYEAVGVIGNLVHSSPNIKKEVLSAGALQPVIGLLSSCCPESQREAALLLGQFASTDSDCKVHIVQRGAVRPLIEMLQSPDVQLKEMSAFALGRLAQDSHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDENGLDLLLGLPGSTNTKQQLDGAAALYKLANKSMALSPVDAAPPSPTQRVYLGEQYVNSATLSDVTFLVEGRRFYAHRICLLASSDAFRAMFDGGYREKDARDIEIPNIKWEVFELMMRFIYTGSVDITIEISQDLLRAADQYLLEGLKRLCEYTIAQDITLENIGGMYDLSEAFHAMSLRQACILFILEHFDKLSTMHGQNQLVQRTIPEIREYFCRALTKSTTNLQGLRL

SEQ ID NO: 14412 - protein, 349 aa, Glycine max
MSEAQKHVWEGAIPLQIHLHESEVTTLPPPPPALVLAPRLGYLPLLISLLKPQFSSTLPPGVDTIWFEYKGLPLKWYIPTGVLFDLLCVEPERPWNLTVHFRGYPSNILLPCEGEDSVKWSFINSLKEAAYIINGNSKNVMNMSQTDQVELWGSVLNGNLETYRRVASKLKLGTFEDEYMENVSSVLIKSPQSPGDTDVTGQVKTGRIPVRLYLWTVNEEFDDFEDAPQIDNWDKVSYINRPVEIYKEDGKYFSLNDAVKRILPEFFPENSFVTEGDANINQIEEGESSSDPGSSCNTLEIAEIKFVRVQGIEPILDIPFSWVVNNLMNPEYFLHMCVCLKVSKSNAVQ

SEQ ID NO: 14413 - protein, 349 aa, Phaseolus vulgaris
MSSAQKQVWEGAIPLQIHLHESEVTTLPPPPPALVLAPRIGYLPLLISLVKPHFSSTLPPGLDAVWFDYKGLPLKWYIPTGVLFDLLCVEPERPWNLTVHFRGYPSNVLLPCEGEDSVKWSFINSLKEAAYVINGNSKNVMNMSQPDQVELWSSVLNGNLEIYRRVASKLKLGISEDEYTENVSSVLIKSPQSTGDTDVTGQVKTGRIPVRLYLWTVNEEFDDFEDAPQIDNWDKVSYINRPVELHKEDGKYFSLNDAVKRILPEFFPENSFVIEGNANINQSGEEGERSSDPGSSCNAAEIAEIKFVRIQGIEPVLDIPFSWVVNNFVNPEYFLHMCVCLKVNANAVQ

SEQ ID NO: 14414 - protein, 351 aa, Cajanus cajan
MSEAQKQVWEGAIPLQIHLHQSEVTTLPPPPPALLLAPRIGYLPLLISLLKPHFSTALPPGVDTIWFEYKGLPLKWYIPTGVLFDLLCVEPERPWNLTVHFRGYPSNLLLPCEGEDSVKWSFINSLKEAAYVINGNCKNVMNMSHPDQVELWGSVLNGNLESYQRVASKLKLGTFEDEYAENISSGSIKSPQSTGDMDAAGQVKTGRIPVRLYLWTVNEEFDDFEDAPQIDNWDKVSYINRPVEIHREDGKFFSLNEAVKRILPEFFPENSFVSEGDANINQSAGEEGESSSDPWSSCHPLELAEIKFIRIQGIEPILDIPFSWVVNNLMNPEYFLHICVCLKVSKVNAML

SEQ ID NO: 14415 - protein, 350 aa, Cicer arietinum
MSEAQKYVWKGAIPLQIHLHESEVTTLPPPPPAHVLAPRIGYLPLLISLLKPQFSATLPPGVDTIWFEHKGLPLKWYIPTGVLFDLLCMEPERPWNLTVHFRGFPSNLLLPCEGEDSVKWSFINSLKEAAYVISGNCKNVMNMSQTDQVELWGSVLNGNLETYRRVSSKLKLETFEDEYIENIDSDSTKSEQSTGDAEAAGQVKTSRIPVRLYLWTVNDDFDDFEDAPQIDNWDKVSYFNRPVEIHKEDGKYFSLNDAVKRLLPEYFPESLFVNEGDAIIDRSAGEEGESSCDPGSSCDKLETAKIKCVRIQGIEPSLEIPFSWVVNNLMNPEYFLHMCVCLKVSEASAV

SEQ ID NO: 14416 - protein, 348 aa, Lotus japonicus
MSEAQKYVWEGAIPLQIHLHESEVTTLPPPPPALVLAPRIGYLPLLISLLKPHFSSTLPPGQDTIWFEYKGLPLKWYIPTGVLFDLLCVEPERPWNLTVHFRGYPSNLLLPCEGEDSVKWSFINSLKEAAYVINGNCKNVMNMSQPDQVELWGSVLNGNLESYRRVSSKLKLGTFEDKHTENINSVLPKSESTGDTDAAGQVKSGRIPVRLYVWTVNESLMILRCSSVDDWDKVSYTNRPVEIHNEDGKFFSLNDAVRRLLPEFFQGSSFDNEGDTNINRTTEEGENSGDPGSSFDAHEIAEIKLVRIQGIEPILEIPFSWVVNNLMNPEYFLHMCVCLKISEASAVQ

SEQ ID NO: 14417 - protein, 361 aa, Medicago truncatula
MNEGQEYVWMGSIPLQIHLHESEVTTLPPPPPALVLAPRMGYLPLLISLLKPHFCTTLPPGVDTIWFEYKGLPLKWYIPTGVLFDLLCMEPERPWNLTVHFRGYPSNLLLPCDGEDSVKWSFINSLKEAAYVINGNCKNVMNMSQTDQVELWGSVLNGNLESYRRVSSKLKLETIEDFVPKKETIEDEHTENIDSVSNKSEQSTGDAEAAGQVKTSRIPVRLYLWTVNNDFDDFEDAPNIDNWDKVSYINRPVEIYKEDDKYFSLNDAVKRLLPEYFPESSFVNEEDANINQSTEEGENSSDPASSSHPLEIAEIKCVRIQGISDLPLEIPFSWVVHNLMNPEYFLHMCVCLKVSEANPVQ

SEQ ID NO: 14418 - protein, 351 aa, Lupinus angustifolius
MSEAQKLVWEGSIPLQIHLHQSEITTLPPPPPALVLAPRIGYLPLLISLIKPHFSTTLPPGIDTIWFEYKGLPLKWYIPTGVLFDLLCMEPERPWNLTVHFRGYPSNLLLPCEGVDSVKWSFINSLKEAAYVINGNCKNIMNMSQPDQAELWHSVFSGNLESYRRVSSKLKLGTFEDEYAENINPVSTKSQQSTEETEVAGQLKTGRIPVRLYVWTVSEDFDDLEDAPQIDNWDKVSYINRPVEVHKDDGKYFSLNDAVRSLLPEFFPGSSLVNEEDASINQSTGEEEENTCDPMSSFQPLENAEIKLVRIQGIEPKLEIPFSWVVNNLMNPEYFLHICVCLKLSGAKALQ

SEQ ID NO: 14419 - protein, 148 aa, Glycine max
MDLRVQHPVDVSLPCFSHSQNVKLQLQRRRLSTVSFALAETAASMAVAVTVVGAAATLLVKRSKTSESTQIQFKVCEDCGGSGICSECKGEGFVLRKRSDESAEKARVQAKNMATRFTAGLPKKWSYCTKCSSGRSCSTCGGSGKLSY

SEQ ID NO: 14420 - protein, 147 aa, Cajanus cajan
MDLAVTVSLPCFSQTHTNVKLQLQRRRISTVSSALAETAASMAVAVTVVGAAATLLVKRSKTSESTQIQFKACEDCGGSGICSECKGEGFVLRKRSDESAEKARVQAKNMATRFTAGASKEVELLYKVLFWSILFNLWWHWEVKLLV

SEQ ID NO: 14421 - protein, 145 aa, Cajanus cajan
MDLAVTVSLPCFSQTHTNVKLQLQRRRISTVSSALAETAASMAVAVTVVGAAATLLVKRSKTSESTQIQFKACEDCGGSGICSECKGEGFVLRKRSDESAEKARVQAKNMATRFTAGLPKKWSYCTKCSSGRSCSTCGGTGKLSY

SEQ ID NO: 14422 - protein, 144 aa, Phaseolus vulgaris
MATSVSLPCFSHTHSHNVKLQLQRRRISTVSSALAETAASVAVAVTVVGAAATLLVKRSKTSESVQIQFKACEDCEGSGICSECNGEGFVLRKRSGESSEKARVEAKNMATRFTSRLPKKWSYCTKCSSARSCSTCGGSGKLSL

SEQ ID NO: 14423 - protein, 146 aa, Vigna unguiculata
MATSVSFPCFSQTHSHNVKLQLQRRRISTVSCALAETAASMAVAVTFVGAAATLIVKRSKTSESAQSKIQFKACEDCGGSGICSECNGEGFVLRKRSGENSEQARVQPKNMATRFTSGLPKKWSYCTKCSSGRSCSTCGGSGKLSY

SEQ ID NO: 14424 - protein, 549 aa, Glycine max
MDTPNAQPQAASASTPRTPRKKMTKQLTGKRDDTPLHSAARAGNMSVLKDTVSGSEEGELRVLLTKQNHSGETILFVAAEYGYVEMVRELIQYYDPAGAGIKASNGFDALHIAAKQGDLDIVKILMEAHPELSMTVDPSNTTAVHTAALQGHTEIVKLLLEAGSNLATIARSNGKTALHSAARNGHLEVVKALLGKEPVVATRTDKKGQTALHMAVKGQSLEVVEELIKADPSTINMVDNKGNTALHIATRKGRAQIIKLLLGQTETNGLVVNKSGETALDTAEKTGNSEIKDILLEHGVRSAKAIKAQPGTATARELKQTVSDIKHEVHYQLEHTRQTRRGVQGIAKRINKMHAEGLNNAINSTTVVAVLIATVAFAAIFTVPGQFADDPKVLPAGMTIGEANIAPQAAFLIFFVFDSIALFISLAVVVVQTSVVIIESKAKKQMMAIINKLMWLACVLISVAFLALSFVVVGKDQKWLAIGVTIIGTTIMATTLGTMSYWVIRHRIEASNLRSIRKSSMESRSRSFSVSVMSDSELLNNERKILYAI

SEQ ID NO: 14425 - protein, 546 aa, Phaseolus vulgaris
MESPTVQPQAASASTPRKKMTKQLTGKRDDTSLHSAARAGNLSVLKDTVSGTEGGELRALLTKQNHAGETVLYVAAEYGYVDMVREMIQYYDLAGAGIKARNGFDALHIAAKQGDLDIVKILMETHSELSMTVDLSNTTALHTAALQGHTEIVKFLLEAGSSLATIARSNGKTALHSAARNGHVEVVKALLEKEPAVATRTDKKGQTALHMAVKGQNLAVVEELIKADPSTINMVDNKGNTPLHITTRKSRAQIVKLLLGQTETDSLAVNRAGETALDTAEKTGNSEVKDILLEHGVRSAKALKAQPTTARELKQTVSDIKHEVHYQLEHTRQTRRGVQGIAKRINKMHAEGLNNAINSTTVVAVLIATVAFAAIFTVPGQFADDPKDIPPGSGMTIGEANIAPQAAFLIFFVFDSIALFISLAVVVVQTSVVIIESKAKKQMMAIINKLMWLACVLISVAFLALTFVVVGKDQKWLAIGVTIIGTTIMATTLGTMCYWVIRHRIEASNLRSIRKSSMGSRSRSFSVSVMSDSELLNNDRKILYAI

SEQ ID NO: 14426 - protein, 548 aa, Cajanus cajan
METQTPNVQPQAASTSTPRKKMTKQLTGKKDDTPLHSAARAGNLSVLKDTVSGAEEGELRALLTKQNHAGETVLYVAAEYGYVDMVREMIQYYDLADAGIKARNGFDALHIAAKQGDFDIVNILMGAHPELSMTVDPSNTTALHTAATQGHTEIVKLLMEAGSSLVTIARSNGKTALHSAGRNGHLEVVEALLEKEPSVATRTDKKGQTALHMAVKGQNLEVVEKLIKADPSTINMVDNKGNTALHIATRKGRAQIVKLLLGQAETDALAINRSGETALDTAEKTGNSEVKDVLLEHGVRSAKAIKGQPATGTARELKQTVSDIKHEVHYQLEHTRQTRRGVQGIAKRINKMHAEGLNNAINSTTVVAVLIATVAFAAIFTVPGQFADDPKTLPPRMTLGEANIAPQPAFLIFFVFDSIALFISLAVVVVQTSVVIIESKAKKQMMAIINKLMWLACVLISVAFLALSFVVVGKDQKWLAIGVTIIGTTIMAITLGTMCYWVIRHRIEASNLRSIRKSSMGSRSRSFSVSVMSDSELLNNEHKILYAI

SEQ ID NO: 14427 - protein, 543 aa, Lupinus angustifolius
MAPPQAVSGNTPRKKMTKQLTGKRDDTPLHSSARAGNLDVIKDTLSGADEGEVRKLLAKQNQAGETALYVAAEYGHVDMVRELIQYYDLADAGIKARNGFDALHIAAKQGHFDVLKILMNAHPELSMTVDPSNTTALHTAATQGHIEIVKFLLEAGSSLATIARSNGKTALHSAARNGHLEVVKAILEKEPGVATRTDKKGQTALHMAVKGQSLEVVEELIKADPSTINMVDNKGNTSLHIATRKGRSQIVKLLLGQKETDAKVVNRSGETALDTAEKSGSSDAKAILLEHGVQSAKSIKPQPTTATARELKQTVSDIKHEVHYQLEHTRQTRKRVQGIAKRLNKMHAEGLNNAINSTTVVAVLIATVAFAAIFTVPGQFVDDPKDIPPGMTLGEANIAPKAPFLIFFVFDSIALFISLAVVVVQTSVVVIESKAKKQMMAIINKLMWLACVLISVAFLALSFIVVGKDEKWLAIAVTIIGTTIMATTLGIMCYWVIRHRIEASNLRSIRKSSMGSRSRSFSVSAPMSDSEIPNNEFKKMYAI

SEQ ID NO: 14428 - protein, 546 aa, Arachis hypogaea
MATPTVQQEAAAVAAAPRKKMTKQLTGKRDDTTLHSAARAGNLALIKDTLSGAEEGQLHELLAKQNQAGETALYVAAEYGYVDLVKEMIRYYDLADAGIKARNGFDALHIAAKQGDLDVLKILMEAHPELSMTVDPSNTTALHTASTQGHTEIVKFLLEAGSSLATIARSNGKTALHSAARNGHLAVVKALLEKEPGVVTRTDKKGQTALHMAVKGQNLEVVEELIKGDPSSVNMIDNKGNTALHIATRKGRAQIVKLLLGQKETDTTAVNKSGESALDTAEKTGNSEIKAILSEHGVQSAKAMKPKPTTAARELKQTVSDIKHEVHYQLEHTRQTRKRVQGIAKRINKMHAEGLNNAINSTTVVAVLIATVAFAAIFTVPGQFVDDPKNIPKGMSLGEANIAPTAAFIIFIVFDSIALFISLAVVVVQTSIVVIESKAKKQMMAIINKLMWLACVLITVAFLALSFIVVGKDQKWLAIGVTVIGTTIMATTLGLMCYWVIRHRIEASNLRSIRKSSMGSRSRSFSVSVMSDTEILNNEYKKMYAI

SEQ ID NO: 14429 - protein, 541 aa, Cicer arietinum
MQPQAAPAKPLRKKMTKQLTGKRDDTPLHSAARAGNMASLKDTVAGAEEGKLHELFAKQNQGGETALYVAAEYGYVDFVREMIQYYDLSDAGIKARNGFDALHIAAKQGDLDILKILMEAHPELSMTVDPSNTTALHTAATQGHTEIVKFLLEAGSSLATIARSNGKTALHSAARNGHLDVVKAILEKEPGVVTRTDKKGQTALHMAVKGQNLEVVEELIKADPSSINMVDNKGNTALHIATRKGRIQIIKLLLGQNETNGMAINKSGETALDTAEKTGNSQVKEILIEHGIQIGKSIKSQPTTTTARELKQTVSDIKHEVHHQLEHTRQTRKSVQGIAKRLNKMHTEGLNNAINSTIVVAVLIATVAFAAIFTVPGQFVDDPKHIPAGKSLGEANIAPKAAFLIFFVFDSVALFISLAVVVVQTSIVVIESKAKKQMMAIINKLMWLACVLISVSFLALSFLVVGKDERWLAISVTIIGTIIMATTLGTMCYWVIRHRIEASNLRSIRKSSLGSRSRSFSVSVMSDSEILNNDRRKMYAI

SEQ ID NO: 14430 - protein, 546 aa, Medicago truncatula
MDTEAETVQPQAAPVRAQRKKMTKQLTGKRDDTPLHSAARAGNMASLKDTVDGAEEGKLREIFAKQNQGGETALYVAAEYGYVDMVREMIQYYDLADAGIKARNGFDALHIAAKQGDLDIVKILMEAHSELSMTVDPSNTTALHTAATQGHTEIVKYLLEAGSSLATIARSNGKTALHSAARNGHLEVVKAILEKEPGVVTRTDKKGQTALHMAVKGQSLVVVEELIKADPSTINMVDNKGNTALHIATRKGRTQIIKLILGQSETNGMAVNKSGETALDTAEKTGNSEVKSILTEHGVQSSKSIKSQPKTAATRELKQTVSDIKHEVHHQLEHTRQTRRSVQGIAKRLNKMHTEGLNNAINSTTVVAVLIATVAFAAIFTVPGQFVDDPKKVRKGKSLGEANIASEPAFLVFIVFDSVALFISLAVVVVQTSIVVVESKAKKQMMAIINKLMWVACVLISVSFLALSFLVVGKKQRWLAIGVTIIGTTIMATTLGTMSYWVIRHRIEASSIRKSSMGSRSRSFSVSVVMSDSEILNNERTKMYAI

SEQ ID NO: 14431 - protein, 545 aa, Lupinus angustifolius
MAQPQAVPGSGNIPRKKMTKQLTGKKDDTPLHSAARAGNLDVIKDTLSGTDEGEVRELLAKQNQAGETALYVAAEYGHIDMVRELIQYYDLADAGIKARNGFDALHISAKQGHLDVLKILIEAHPELSMTVDPSNSTALHTAATQGHIEIVKFLLGVGSSLATIARSNGKTTLHSAARNGHLEVVKVILEKEPGVTTRTDKKGQTALHMAVKGQSLEVVEELIKADPSTINMVDNKGNTALHIATRKARSQIIKLLLGQSETDTKLVNRSGETALDTAEKNGNSNVKAILLEHGVQSAKAIKPQATTTTARELKQTVSDIKHEVHYQLEHTRQTRKRVQGIAKRLNKMHAEGLNNAINSTTVVAVLIATVAFAAIFTVPGQFVDDPKDIPPGMSLGEANIAQNAPFLIFFVFDSIALFISLAVVVVQTSVVVIESKAKKQMMAIINKLMWLACVLISVAFLALSFVVVGKDEKWLAIVVTIIGATIMATTLGIMCYWVIRHHIEASNLTSIQKSSMGSRSRSFSVSAPMSDSEILNNVFNIMYAI

SEQ ID NO: 14432 - protein, 545 aa, Cajanus cajan
MATPSLPPIIAPRKKMTKQLTGKRDDTPLHSAARAGNLAVLKETILGTNEAALRELLAKQNQDGETPLYIAAEYGYVDVVREMIPYYDLADAGIKARNGFDALHIAAKQGDLDVLKILMEGHPELSMTVDPSNTTALHTAALQGHTEIVKFILEAGSSLATIARSNGKTALHSAARNGHLEVVKALLEKEPGVATRTDKKGQTALHMAVKGQNLEVVEELINGDPSSINMVDSKGNTALHIATRKGRAQIVKLLLEQKETATNAVNRCGETALDTAEKTGNHDLKVILLEHGVQNARTIKPQKGTTATTARELKQTVSDIKHEVHHQLEHTRQTRKRVQGIAKRINKMHVEGLNNAINSTTVVAVLIATVAFAAIFTVPGQFVDDPNNIPPGMSLGEANIAPQASFIIFFVFDSIALFISLAVVVVQTSVVVIESKAKKQMMAVINKLMWLACVLISVAFLALSFVVVGKEEKWLAIGVTIIGATIMATTLGTMCYWVIRHRIEASNLRNVRKSSLQSKSKSFSVSAFSDSELLNSEYNKKMYAI

SEQ ID NO: 14433 - protein, 545 aa, Glycine max
MATPAMQAVNTTRKKMTKQLTGKRDDTPLHSAARAGNLAVLKDTILETDEAELHELLAKQNQDGETPLYIAAEYGYVDVVREMIQYYDLADAGIKARNGFDALHIAAKQGDLDVLKILMEGHPELSMTVDPSNTTALHTAAIQGHTEIVKFLLEAGSSLATIARSNGKTALHSAARNGHLVVVKALLEKEPGVATRTDKKGQTALHMAVKGQNIEVVEELIKADPSSINMVDSKGNTALHIATRKGRAQIVKLLLEQKENVTSAVNRCGETAVDTAEKTGNHAVQAILLEHGVESARTIKPPQGTTATTARELKQTVSDIKHEVHHQLEHTRQTRKRVQGIAKRINKMHAEGLNNAINSTTVVAVLIATVAFAAIFTVPGQFVDDPNNIPAGMSLGEANIAPQATFIIFFVFDSIALFISLAVVVVQTSVVVIESKAKKQMMAVINKLMWLACVLISVAFLALSFVVVGKEEKWLAIGVTIIGTTIMATTLGTMCYWVIRHRIEASNLRSIRKSSLQSKSKSFSVSAFSDSELLNSEYYKKMYAI

SEQ ID NO: 14434 - protein, 545 aa, Glycine max
MATPAMQAVNTTRKKMTKQLTGKRDDTPLHSAARAGNLAVLKDTILETDEAELHELLAKQNQDGETPLYIAAEYGYVDVVREMIQYYDLADAGIKARNGFDALHIAAKQGDLDVLKILMEGHPELSMTVDPSNTTALHTAAIQGHTEIVKFLLEAGSSLATIARSNGKTALHSAARNGHLVVVKALLEKEPGVATRTDKKGQTALHMAVKGQNIEVVEELIKADPSSINMVDSKGNTALHIATRKGRAQIVKLLLEQKENVTSAVNRCGETAVDTAEKTGNHAVQAILLEHGVESARTIKPPQGTTATTARELKQTVSDIKHEVHHQLEHTRQTRKRVQGIAKRINKMHAEGLNNAINSTTVVAVLIATVAFAAIFTVPGQFVDDPNNIPAGMSLGEANIAPQATFIIFFVFDSIALFISLAVVVVQTSVVVIESKAKKQMMAVINKLMWLACVLISVAFLALSFVVVGKEEKWLAIGVTIIGTTIMATTLGTMCYWVIRHRIETSNLRSIRKSSLQSKSKSFSVSAFSDSELLNSEYYKKMYAI

SEQ ID NO: 14435 - protein, 545 aa, Glycine max
MATPAMQAVNTPRKKMTKQLTGKRDDTPLHSAARAGKLAVLKDIILGTDETELHELLAKQNQDGETPLYIAAEYGYVDVVREMIQYYDLVDAGIKARNGFDALHIAAKQGDLDVLKILMEGHPELSMTVDPSNTTALHTAAIQGHTEIVKFLLEAGSSLATIARSNGKTALHSAARNGHLEVVKALLEKEPGVATRTDKKGQTALHMAVKGQKIEVVEELIKADPSLINMLDSKGNTALHIATRKGRAQIVKLLLEQKENVTSAVNRCGETAVDTAEKTGNHEVQAILLEHGVQSARTIKPPQGTTATTARELKQTVSDIKHEVHHQLEHTRQTRKRVQGIAKRINKMHAEGLNNAINSTTVVAVLIATVAFAAIFTVPGQFVDDPNNIPPGMSLGEANIAPQAPFIIFFVFDSIALFISLAVVVVQTSVVVIESKAKKQMMAVINKLMWLACVLISVAFLALSFVVVGKEEKWLAIGVTIIGTTIMATTLGTMCYWVIRHRIEASNLRNIRKSSLQSKSKSFSVSAFSDSELLNSEYYKKMYAI

SEQ ID NO: 14436 - protein, 536 aa, Cicer arietinum
MQSLAVSTPRKKMTKQLTGKRDDTPLHSAARAGNLDVVKDTLKDAEEDELLDLLARQNQDGETALYVAAEYGYIDVVREMIQYYDLTAAGVKARNGFDAFHIAAKQGDIDILKILMEVHPELSMTVDPSNTTALHTAATQGHIEIVKFLLEAGSSLATIAKSNGKTALHSAARNGHLEVVKALLEKEPSVAIRTDKKGQTALHMAVKGQNLEVVEKLIKADPSTINMVDTKGNTALHIATRKARCQIVKMLLGEKETNISAVNRSGETAIDTAEKVGSHDVQAILLEHGVQSAKSIKPQTTARELKQTVSDIKHEVHYQLEHTRQTRKRVQGIAKRINKMHAEGLNNAINSTTVVAVLIATVAFAAIFTVPGQFVDDPNNIPPGMTLGEANIAPQAPFIIFFVFDSIALFISLAVVVVQTSVVVIESKAKKQMMAIINKLMWLACVLVSVAFLALSFVVVGKEEKWLAIGVTIIGTTIMATTLGTMCYWVIKHRIESSNLRNIRKSSMESKSKSFSVSAFSDSELLNNEFKKMYAI

SEQ ID NO: 14437 - protein, 545 aa, Phaseolus vulgaris
MERPALQAINTHRKKMTKQLTGKRDDTPLHFAARAGNLDVLKDAILGTDEAELHELLSKQNQDGETLLYIAAEYGYIDVVREMIQYYDLADAGIKARNGFDALHIAAKQGDLDVMKVLMESHPELSMTVDPSNTTALHTAAIQGHTEIVKFLLEAGSSLATIARSNGKTALHSAARNGHVVVVKAILEKEPGVATRTDKKGQTALHMAAKGQKLEMVEELIKADPSSINMVDSKGNTALHIATRKGRSKIVKLLLEQKETITSAVNRSGETALDTAEKTGNNDVKAILLEYGVQSARTIKPPQGTTATTARELKQTVSDIKHEVHHQLEHTRQTRKRVQGIAKRINKMHAEGLNNAINSTTVVAVLIATVAFAAIFTVPGQFVDDPHDIPPGMSLGEANIAPEVSFIIFFVFDSVALFISLAVVVVQTSVVVIESKAKKQMMAVINKLMWLACVLISVAFLALSFVVVGKEEKWLAIGVSIIGTTIMATTLGTMCYWVIRHRIEASNLKNVRKSSLHSRSKSFSVSAFSDSELLNSEYYKKMYAI

SEQ ID NO: 14438 - protein, 460 aa, Glycine max
MNPNDGNNSPSPKPLEMVNPVPPFLSKTFDLVDAPTLDPIISWNSTGLSFVVWDPLEFARIVLPRHFKHNNFSSFVRQLNTYGFRKIDTDKWEFFNEAFQRGKKHLLKNIQRRRSSQSQPVGSYIGIGSSTEAGGSEVEIEIERLRKEKTMLMEEVVDLQQEQRRTAHHAGEVNLRLQSAEQRQKQMVSFLAKLIQNPAFLARLRHKKEQKEIDSPRVVRKFVKQHHETGTTTTAETLQEGQIVRYQPDWRNIAMSSETPKLSSVSIEQSPHYLSQGLAGEMSVVGAEDLTAQIDNIVSDDLAAVHGITPSQEMMIGEGSSTFGAEDPLFKGKSVMSPILEVPPEYFPSFPEGLTKEKKDFQDFSALGTEGMIKLEDIWDSGLNVSGAALSSGNELWGNHVNYEEFPQFGVTSGMSDSDIWDIGLGSFGIDTWPTDEPSLGETDGQSGQPNEDRSKNFDP

SEQ ID NO: 14439 - protein, 452 aa, Phaseolus vulgaris
MNPTDDNFPKPLEVLQMNPVPPFLSKTFDLVDDPTLDPIISWGSTGFSFVVWDPLEFARIVLPRHFKHNNFSSFVRQLNTYGFRKIDTDKWEFFNEAFQRSKKHLLKNIQRRRSTQFQQVGSYIGIGSSTEAGRSEVEVEIEKLRNERTMLMEEVVDLQQEQRRTANRAGEVNQRLQSAEQRQKQMVSFLAKLIQNPAFLARLRHKKEQREIDSPRVVRKFVKQHQHESGTVETLQEGQIVRYQPDWRNIDMSSETPKLSQVSIEQSPHYLSQCLAGEMSGGAEDLTSQIENIVTDDLAAEHGITPPQEMMIGSSFGAEDPLYKGKSVMSPSLELPPEYFTSFPEVLTQEKGFQDFSALGTEDIIKLEDIWDSDLNLSGAGSTCGNELWGNPMNYEDVPEFGVTSGMSESDIWDIGSGSLGIHKWPGDEPSIGEIDGQVGEPKEDRPQNLDP

SEQ ID NO: 14440 - protein, 930 aa, Glycine max
MKRFSACCFTSRISKFHSHWKRNHSRSQIMAGIISGPSGSEGVNILLNHDFSSELNSWHLNNCTGYVISAESGNQGGISMESNVNYVVITDRKECWQGLEQDITNRISIGSTYTVSACVGVSGLSQRSSDVIATLKLEYHDSATRYLFIGRTSVNKDSWEKLEGTFSLSTMPHRVIFYLEGPAPGVDLLIRSVEINCSTPNNSTTSTGCVSAGDDNIIINPQFDDGLNNWSGRGCKIMLHDSMNDGKIVPKSGKFFASATERTQSWNGIQQEITGRVQRKLAYEVTALVRIFGNNVSTADVRATLWVQTPDLREQYIGIAKVQATDKDWVTMQGKFLLNGSPSKVVLYLEGPPPGTDILLNNLILKHAAKTPPSTPPDLKNIAFGVNIIENSNLADSTNGWFPLGNCTLSVKTGSPHIIPPMARDSLGSHEFLSGRYILVTNRTQTWMGPAQTITDKVKLFVTYQVSAWVRIGSGSSGPQNVNVALGVDNQWVNGGQTQVSDDMWHEIGGSFRIEKQPSKVMVYVQGPASGVDLMVAGLQIFPVDRHTRFRYLKIQTDKIRKRDVILKFSGLDSGSYANTSVKVIQTQNDFPIGTCISRMNIDNEDFVNFVVKHFNWAVFENELKWYWTEPQQGNFNYKDADNLLSLCQKHKIQTRGHCIFWEVDETVQQWIKSLNKNDLMTAVQNRLNGLLTRYKGKFSHYDVNNEMLHGSFYQDRLGKDIRANMFKTANQLDPSATLFVNDYHVEDGRDTRSSPDKYIHHILDLQEQGAPVGGIGIQGHIDSPIGPIVSSSLDKLGILGLPIWFTELDVSSVNEYVRADDLEVMLREAMAHPTVEGIMLWGFWELFMSRDNSHLVNAEGDINEAGKRFLSLKQEWLSHSRGHVDEQGQYNFRGFHGTYDVQVVTPSKKISKTFVLDKGDSPLVVSIDL

SEQ ID NO: 14441 - protein, 901 aa, Cajanus cajan
MAGNSSDPSGNKTANILINHDFCSGLNSWHLNNCNGYVISAETGTQGGTSMKSDGNYAVITDRKECWQGLEQDITDRISIGSTYTVSACVGVSGLSQGHSDVLATLKLEYHNSATSYLFIGRTSVNKDSWEKLEGTFSLSTMPDRVIFYLEGPAPGVDLLIRSVEINCSSSNNNATSTGCVSAGDDNIIINPQFDDGLNNWSGRGCKIMLHDSMNGGKIVPKSGKFFASATERTQNWNGIQQEITGRVQRKLAYEVTALVRIFGNNVSTADVRATLWVQTPDLREQYIGIASVQATDKDWVTMQGKFLLNGSPSKVVLYLEGPPPSTDILLNNLVLKHAAKTPPSTPPDVKNVAFGVNIIENSSLADNTNGWFPLGNCTLSVKTGSPHIIPPMARDSLGPHELLSGRYILVTNRTQTWMGPAQVITDKVKLFVTYQVSAWVRIRSGASGPQNVNVALGVDNQWVNGGQTEVYDDMWHEIGGSFRIEKQPSKVMVYVQGPASGVDLMVAGLQIFPVDRHARFRYLKIQTDKIRKRDVILKFSGLDSGSYANTSVQVRQTQNDFPIGSCISRTNIDNEDFVDFMAKHFNWAVFGNELKWYWTEPQQGNLNYKDADDLLTLCQKHKIQTRGHCIFWEVDGTVQQWVKSLNNNDLMTAVQNRLNGLLTRYKGKFSHYDVNNEMLHGSFYQDRLGKDIRANMFKTANQLDPSATLFVNDYHVEDGCDTKSCPDKYIHHILDLQEQGAPVGGIGIQGHIDSPIGPVVSSSLDKLGVLGLPIWFTELDVSSINEYVRGDDLEVMLREAMAHPAVEGIMLWGFWELFMSRDNAHLVNAEGDINEAGKRFLALKQEWLSHSRGHVDEQGQYNFRGFHGTYNVQVVTPTKKISKTFVLDKGDSPLVVSIDL

SEQ ID NO: 14442 - protein, 901 aa, Phaseolus vulgaris
MAGNISDPSGSKGANILLNHDFSSGLSSWHLNSCSGYVISAETGAQGGISRELSANYAVITDRKECWQGLEQDITDRISTGYTYTVLACVGVSSLSQGSSDVLATLKLEYHDSATSYLFIGRTSVNKDSWQKLEGTFSLSTMPDRVVFYLEGPAPGVDLLIRSVEINCSTPNNNTTSTACVSAGDDNIIINPQFDDGLNNWSGRGCKIMLHDSMNDGKIVPKSGKFFASATERTQNWNGIQQDITGRVQRKLAYEVTASVRIFGNNVSTADVRATLWVQAPDLKEQYIGIANLQATDKDWVTMQGKFLLNGSPSKVVLYLEGPPPGTDILLNNLVLKHAAKTPPSSPPDVKNVTFGVNIIENSTLADGTNGWFPLGNCTLSVKTGSPHIVPPMARDSLGPSELLSGRYILVTNRTQTWMGPAQIITDKVKLFLTYQVSAWVRIVSGSSGPQNVNVALGVDNEWVNGGQTEVSDNTWHEIGGSFRIEKQPSKVMVYVQGPASGVDLMVAGLQIFPVDRHARLRYLKIQTNKIRKRDVILKFSGLDSGSYANTSVQVRQTQNDFPIGTCISRSNIDNEDFVDFMVKHFNWAVFGNELKWYWTEPQQGNFNYKDADDLLSLCQKHNIQTRGHCIFWDVDGVVQQWIKSLNNNDLMTAIQNRLNGLLTRYKGKFNHYDVNNEMLHGSFFQDRLGKDIRANMFKTANQLDPSATLFVNDYHVEDGCDTRSCPDKYIHHILDLQEQGAPVGGIGIQGHIDSPIGPIVSSSLDKLGILGLPIWFTELDVSSINEYVRADDLEVMLREAMAHPAVEGIMLWGFWELFMSRDNAHLVNAEGDINEAGKRFLALKQEWLSHSRGHVDEQGQYNFRGFHGTYNVQVVTPSKKISKTFVLDKGDTPLVLSIDL

SEQ ID NO: 14443 - protein, 928 aa, Lupinus angustifolius
MKMFSACCFTNKISKFLSHKKHKKSQPQIIAGNISGSSRSMATNVLLNHDFSGGLNSWRLNCCNGYVISAEAGSHKGVGSDSNYAVITDRKECWQGLEQDITDRISIGSTYTVSASVGVSGLSQGSADVIATVKLEYNDKPTSYLFIGRTSVVKDSWEKLEGTFSLSTVADRVIFYLEGPASGVDLLIRLVEINSSSPDDNATSIGCVSTGDDNIIINPQFEDGLNNWSGRGCKILLHDSMGDGKILPQSGKGFASATERTQSWNGIQQEITARVQRKLAYEVTALVRIFGNNVTTSDVRATLWVQTPDLREQYIGIANVQATDKDWINMQGKFLLNGSPSKVVIYLEGPPPGTDILVNTLSIKHAAKTPPSTQPDVKNVAFGVNVIENSSLADGNNGWFPLGNCTLSVRTGSPHIIPPLARDSLGPHELLSGRYILVTNRTQTWNGPAQTITEKLKLFLTYQVSAWVRIGSGSNGPQNVNVALSVDNQWVNGGQTEVSDDRWHEIGGSFRIEKQPSKVMVYVQGPAAGVDLMVAGLQIFPVDRHARFRYLKMQTDKIRKRDVIMKFPGLDSSSYPKTSVQVRQIRNDFPIGTCISRTNIDNEDFVNFVVKHFNWAVFGNELKWYWTEPQQGNFNYRDADDLLNLCHKNSIQTRGHCIFWDVDDTVQQWIKSLNKNDLMTAVQNRLTGLLTRYKGKFSHYDVNNEMLHGSFYPDRLGKDIRANMFKTANQLDPSATLFVNDYHVEDGCDTRSCPEKYIQHILDLQEQGAPVGGIGIQGHIDTPVGPIVCSSLDKLGILGLPIWFTELDVSAINEYIRADDLEVMLREALAHPAVEGIMLWGFWELFMSRDNAHLVNAEGDINEAGNRFLALKQEWLSHRHGNVDEQGQFNFRGFHGTYNVQVVTDTKKISKTFVLDKGDSPLVISIDI

SEQ ID NO: 14444 - protein, 898 aa, Cicer arietinum
MSGPSGSKAANILLNHDFSGGLNSWRLNCCNGYVISAEAGSQGGILLESEHNYAVITDRKECWQGLEQDITDRVSMGSTYMVSAFVGVSGLSQGSADVLATLKLEYHDSATHYVFIGRTSVKKGSWEKLEGTFSLSTKPDRVIFYFEGPAPGVDLLIRSVEINCSSPNNNATNTEGCVSTGDENIIINPQFEDGLNNWSGRGCKIVLHDSMADGKIVPKSGKFFACSTERTQNWNGIQQEITGRVQRKLAYEIAALVRIYGNNVTNADVRSTLWVQTPDLREQYIGIANVQATDTDWVTMQGKFLLNGSPSKVVLYLEGPPPGTDILVNTLVVKHAAKTPPSTPPNVQNVAFGVNVIENSNLSDDTKGWFPLGNCTLSVKTGSPHIIPPMARDSLGPHELLSGRYILVTNRSQTWNGPAQVITDKLKLFLTYQVSAWVRIGSGSNGPQNVNVALGVDNQWVNGGQTEVSDDRWHEIGGSFRIEKQPSKVMVYIQGPASGVDFMVAGLQIFPADRHARFRYLKMQTDKIRKRDVVLKFPGLDSSSYPNTTVQVRQTQNDFPIGTCISRSNIDNEDFVNFLVKHFNWAVFGNELKWYWTEPQQGNLNYKDADDLLSLCQKYKIETRGHCIFWEVDGTVQQWIKSLNKNDLMTAVQNRLTSLLTRYKGKFSHYDVNNEMLHGSFYQDRLGKDIRANMFKIANQLDPSATLFVNDYHIEDGCDTRSCPDKYIQHILDLQEQGAPVSGIGIQGHIDSPIGPIVCSSLDKLGILGLPIWFTELDVSSLNEYVRGDDLEVMLREAFAHPAVEGIMLWGFWELFMSRDNAHLVNAEGDINEAGKRFLALKQEWLSHSHGHVDEQGQYNFRGFYGTYNVDVVTPSKKISKTFVLDKGDSPLVVSFDL

SEQ ID NO: 14445 - protein, 903 aa, Medicago truncatula
MAGNISGPSVSNAANILLNHDFSNDLNSWHLNCCNGYVISSKAGGQGVNLMDSDCNYAVITDRNEGWQGLEQDITDRISIGSAYTVSAFVGVSGLSQESVDVKATLKLEYHDSATNYLFIGRSSVMKGSWEKLEGTFSLSTKPDRVVFYLEGPAPGIDLLIRSVEINCSIPNDNKFISTEACVSTGDESIIINPQFEDGLNNWSGRSCKIVLHDSMADGKIVPKSGKYFACATERTQFWNGIQQEITGRVQRKLAYEITALVRIYGNNVTNADVRATLWVQTPDLREQYIGIANVQATDTDWVTLQGKFLLNGPTSKAVLYLEGPPSGTDILVNTLVVKHAAKTPPSTPPAAQNVAFGVNIIENSNLSDDTKGWFTLGNCPLTVKTGSPHILPPMARESLGPHGILSGRYILVTNRTQTWMGPAQVITEKLKLFLTYQVSAWVRIGSSSNGPQNVNVALGADNQWINGGQTEVSDDRWHEIGGSFRIEKQPTKIMVYIQGPASGVDLMVAGLQIFPVDRHARFRYLKMQTDKIRKRDVVLKFAGLDSSSYLNTMVQVRQTQNNFPIGTCISRSNIDNEDFVNFLVKHFNWAVFANELKWYWTEPQQGNLNYKDADDLLTLCQKYKIQTRGHCIFWEVDGTVQQWVKSLNKNDLMTAVQNRLTSLLTRYKGKFSHYDVNNEMLHGSFYQDRLGKDIRANMFKTANQLDLSATLFVNDYHIEDGCDTRSCPNKYIEHILDLQEQGAPVGGIGIQGHIDSPVGPVVCSSLDKLGILGLPIWFTELDVSSMNEYVRGDDLEVMLREAMAHPAVEGIMLWGFWELFMSRDNAHLVNAEGDINEAGKRFLALKQEWLSHSHGHVNEQGQFNFRGFYGTYNVEIVTPSKKISKTFVLDKGDSPMEVSIDL

SEQ ID NO: 14446 - protein, 461 aa, Glycine max
MANRSDPDIDDDFLELYKEYTGPLGSATTNTQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDSVHKIREEGDQRGTSSSQMTRSRSPERSPVSARFQRSEPQRSHSGPRNTSQFQQRFGRQERAVEDRIRDDVQKFSRGSPQAYGNSGARGRSSQSRSPRHAPYTGNSYNSFEGRNQNMGAYRNDGWDSHRRESGIRPGHQFDYSASPQTLEELELEYKNEAAELMKIRDREEDEENFKHREAIRDLREKYMSKVSLVRDTHAKQWEGFLQLDAQRRQQQAVQQMPSGYRGFKQQSFPEYDGSTANPPPYAGSNLPLESRNRFSDNMETYPNRPHDNFGEFHRRGDFAKAYNRY

SEQ ID NO: 14447 - protein, 461 aa, Cajanus cajan
MANRPDPDIDDDFRELYKEYTGPLGSAATNTQERAKSNKRSDAGSDEEEEARDPNAVPTDFTSREAKVWEAKSKATERNWKKRKEEEMICKLCGESGHFTQGCPSTLGANRKSQDFFERVPARDKNVRALFTEKVINKIERDVGCKIKMDEKFIIVSGKDRLILAKGVDAVHKIREEGDQKGSSSSQMTRSRSPERSPVGARFQRSEPQRSHSGPRNTSQFQPRFGRQERAVEDRIREDVQKFTRGSPQAFGNSGARGRSSQSRSPRHAPYTVNSYNSFEGRNQNMGAYRNDGWDSHRRESVIQPGHQFDYNASPQTLEELELEYKNEATELMKIRDREEDEENFKHREAIRDLREKYMNKVALVRATHAKQWEEFLQLDAQRRQQQAIQQMSSSYRGFKQQSFPEYDGSNVNPPPFTGTNLPLESRNRFSDNMETYPTRPHDNFGEFHRRGDFAKAYNRY

SEQ ID NO: 14448 - protein, 461 aa, Phaseolus vulgaris
MANRPDPDIDDDFRELYKEYTGPPGSGTTNTQERAKPNKRSNAGSDEEDEARDPNAVPTDFTSREAKVWEAKSKATERNWKKRKEEEMICKLCGESGHFTQGCPSTLGANRKSQDFFERIPARDKNVRALFTEKVLSKIERDIGCKIKMDEKFIIVSGKDRLVMAKGVDAVHKIREEGDQRGSSSSQMTRSRSPERSPVNARFQRSEPQRSHSGPRNTSQFQQRFGRQERAVEDRIREDVQKFARGSPQAYGNSGARGRSSQSRSPRHAPFTGNSYSSFDGRNQNMGAYRNDGWDSHRRESGIQPGHQFDFNASPQTLEELELEYKNEAAELMKIRDREEDEENFKHREAIRDLREKYMSKVGLVRATHAKQWEDFLQHDAQRRQQQAVQQMSSGYRGFKQQSFPEYDGSSVNPPPYAGANLPLDSRNRFSDNMETYTTRPHDNFGEFHRRGDFGKAYNRY

SEQ ID NO: 14449 - protein, 462 aa, Lotus japonicus
MANRPDPDNDDDFLELYKEYTGPLGSTAATNTQEGAKSNKRSNAGSDEEDEPRDPNAVPTDFTSREAKVWEAKSKATERNWKKRKEEEMICKLCGESGHFTQGCPSTLGANRKSQDFFERIPARDKNVRALFTEKVISKIERDTGCKIKMDEKFIIVSGKDRLIFSKGVDAVHKVREEGDQKGTSSSHRSKSRSPERSPVSARFNRSEPQRSHSGPRSSSQFQQRFSRPERVVEDRVREDVQKFARGSPQAYGNSGARGRSSHSRSPRQAPYPGNSYNSFDGRNENMGTYRNDGWDSHRRESGFQPGHQLDYSASPQTLEELELEYKNEAVELMKSRDREEDEENFKHREAIRDLREKYMSKVALLRATHAKKWDEFLQLDARRCQQQAIQHMPPSGYRGYKQQNFSEYDGSTANPPYAGTNFPMEPKNRFSDTMETYPTRSHDNFGEFQRRGDFAKAYNRY

SEQ ID NO: 14450 - protein, 461 aa, Arachis hypogaea
MANRADPDIDDDLRDLYKEYTGPLGSAPTNTQDREKSNKRSHAGSDEEEEPRDPNAVPTDFTSREAKVWEAKSKATERNWKKRKEEEMICKLCGESGHFTQGCPTTLGANRKSQDFFERIPARDKNVRALFTEKVLNKIERDIGCKIKMDEKFIIVSGKDRLILAKGVDAVHKIREEGEQRGTSSSHMARSRSPEQSPVGARFQRSEPQRSHSGPRNASQFQQRFGRQERAVEDRVREDMQKFARGSPQAYGNSGARGRSSHSRSPRQPPYTGNSYNSIDGRNQNIGSYRNDGWDSHRRESAGIQPSHQFDYSTSPKTLEELELEYKKEATELMKNRDREEDEENFKHREAVRDLRENYMNKVAMLRVSHAKQWEEFLQLEAHRHQQHTIQQIPSGFGSYKQQNFTEYDGSAVNPHYAGPNLPLESRNRFSDMENYPTRPHDNFGEFQRRGGDFAKAFNRY

SEQ ID NO: 14451 - protein, 281 aa, Solanum tuberosum
MYRFTNTVIGFLNLFTLLASIPIIGAGLWMARSTTTCEKFLQTPLLFIGFIILIVSLAGFIGACFHVAWALWLYLFVMLFLIGALMGLTVFGFVVTSQGGGMDVPGKVYKEYHLQNYSPWLRKRIKDPQYWVTIRACILGSKTCANVITWTPYDYLTKDLTPIQSGCCKPPTACNYGLTTMTQEADCYQWNNDPNLLCYECDSCKAGVLEDVRRDWQKISVLNIVMLVLLIGIYSIGCCAFQNTKRAVSDYPHGENRMYKVRPRWDFYWWRWWHDRRHQFY

SEQ ID NO: 14452 - protein, 281 aa, Solanum melongena
MYRFSNTVIGLLNLFTLLASIPIIGAGLWMARSSTTCEKFLQTPLLFIGFIILLVSLAGFIGACFHVAWALWLYLFVMLFLIGALMGLTVFGFVVTSQGGGIDVPGKVYKEYHLQNYSPWLRKRIKDPQYWLTIRACILGSNTCATVITWTPYDYLTKDLTPIQSGCCKPPTTCNYGLTTMTQDSDCYHWNNDPNLLCYECDSCKAGVLEDVRRDWQKISVLNIVMLVLLIGIYSIGCCAFQNTKRATSDYPHGENRMYKVRPRWDFYWWRWWHDRRHQLY

SEQ ID NO: 14453 - protein, 281 aa, Capsicum annuum
MYRFSNTVIGFLNLFTLLASIPIIGAGLWMARSSTTCEKFLQTPLLFIGFIILIVSLAGFIGACFHVAWALWLYLFVMLFLIGALMALTVFGFVVTSPGGEVDVPGKVYKEYDLQNYSPLLRKRIKDPQYWVTIRACILGSKTCATVITWTPYDYLTKDLTPIQSGCCKPPTKCNYGLTAIKQEVDCYHWKNDPNMLCYECDSCKAGVLEDMRRDWQKISVLNIVMLVILIGIYSVGCCAFQNTKRAESDYPHGENRMYKVRPRWDFYWWRWWHDRRHQLY

SEQ ID NO: 14454 - protein, 281 aa, Nicotiana benthamiana
MYRFSNTVIGFLNLFTLLASIPIIGAGLWMARSSTTCEKFLQTPLLFLGFIILIISLAGFIGACFHVAWALWIYLFVMLFLIGALMGLTVFGFVVTSQGGVVDVPGKVYKEYHLDNYSTWLKKRIKDPQYWMTIRACILGSKTCATVITWSPYDYLTKDLTPIQSGCCKPPTACNYGLTTLSQDPDCYRWSNDPNLLCYECDSCKAGVVEDVRRDWQKISVLNIVMLVFLIGIYSIGCCAFQNTKRAVSDYPHGQNRMSKVRPRWDFHWWRWWHDRRRQLY

SEQ ID NO: 14455 - protein, 280 aa, Nicotiana benthamiana
MYRFSNTVIGFLNLFTLLASIPIIGAGLWMARSSTTCEKFLQTPLLFLGFIILIISLAGFIGACFHVAWALWLYLFVMLFLIGALMGLTVFGFVVTSQGGVVDVPGKVYKEYHLENYSAWLKKRIKDPQYWMTIRACILGSKTCATVITWSPYDYLTKDLTPIQSGCCKPPTACNYGLTTLSQDPDCYRWNNDPNLLCYECDSCKAGVLEDVRRDWQKISVLNIVMLVFLIGIYSIGCCAFQNTKRAVSDYPHGQNRMSKVRPRWDFHWFVTSHPSPIFT

SEQ ID NO: 14456 - protein, 281 aa, Citrus clementina
MYRFSNTVIGFLNLFTLLASIPIIGAGLWMARSSTTCESFLQTPLLVIGFVVLIVSLAGFIGACFNVAWALWVYLVVMLFLIATLMALTIFGFVVTSQGGGVQVPGRVYKEYHLQDYSPWLRNRVMDPNYWSTIRSCLLGSKTCAKLALWTPLDYLERDMTPIQSGCCKPPTSCNYNMPTMAQDPDCYRWNNAPTLLCYECDSCKAGVLEDVRRDWHKLSVLNIVMLVVLIGIYSIGCCAFQNTRRAQTDYPYGENQMTKVRPRWDYYWWRWWKDMRERLW

SEQ ID NO: 14457 - protein, 282 aa, Vitis vinifera
MYRFSNTVIGFLNLFTLLASIPIIGGGLWMARSSTTCESFLQTPLLVVGFVVLIISLAGFIGACFNVAWALWLYLVVMLFLIGTLLGLTIFGFVVTSQGGGVEVPGRVYKEYQLEKYSSWLKSRIKDPHYWSTIRSCILGSNTCAQIASWTPLDYLERDMTPIQSGCCKPPTSCNYATATMMTQDADCYRWNNAPNLLCYECDSCKAGVLEHIRRDWHKLSVLNIVMLVLLIGIYSIGCCAFRNTRRSETDYPYGENRMSKVRPRWDFYWWRWWYDRKNQLY

SEQ ID NO: 14458 - protein, 162 aa, Solanum tuberosum
MGKARIIGIGMDYSATSKIALKWAIDNLIEEGDTIIIIHVVSSRVEPTSKQLFEDTGSPLIPLDEFKQINVSKYYGLNPDKEVIDMLEPVAKLKKVTVVSKVYWGDAREKLCDAAESLKLDSLVIGGRGLGVLKRVLLGSVSNYVVQNATCPVTVVKTSPQK

SEQ ID NO: 14459 - protein, 162 aa, Solanum phureja
MGKARVIGIGMDYSATSKIALKWAIDNLIEEGDTIIIIHVVSSKVEPTSKQLFEVTGSPLIPLDEFKQINVSKYYGLNPDKEVIDMLEPVAKLKKVTVVSKVYWGDAREKLCDAAESLKLDSLVIGGRGLGVLKRVLLGSVSNYVVQNATCPVTVVKTSPQK

SEQ ID NO: 14460 - protein, 162 aa, Nicotiana benthamiana
MAKARSIGIGMDYSATSKIALKWAIDNLIEEGDKIIIIHVVSSKLDPTNKQLFEDTGSPLIPLDEFREINVSKYYGLDPDREVLDMLDTVSKLKKVIVVAKVYWGDAREKLCDAAEHLKLDSLVLGSRGLGVLKRMLLGSVSNHLVQNATCPVTVVKSSPPK

SEQ ID NO: 14461 - protein, 162 aa, Nicotiana tabacum
  misc_feature (76)..(76): Xaa can be any naturally occurring amino acid
MAKARSIGIGIDYSATSKIALKWAIDNLIEEGDKIIIIHVVSSKVDTTNKQLFEDTGSPLIPLDEFREINVSKYYXLNPDREVLDMLDTVSKLKKVIVMAKVYWGDAREKLCDAAEHLKLDSLVVGSRGLGVLKRVLLGSVSNHVVQNATCPVTVVKASPSK

SEQ ID NO: 14462 - protein, 169 aa, Petunia hybrida
MAGKARSVGIGMDYSETSKIALKWAIDNLIEEGDRIIIIHVVSSKVDPTNKQLFEDTGSPLIPLDEFREINVSKYYGLDPDREVLDMLDTISKLKKVTVVAKVYWGDAREKLCGAAEHLKLDSLVVGSRGLGVLKRVLLGSVSNYVVQNATCPVTVVKATPLKYSLSYF

SEQ ID NO: 14463 - protein, 170 aa, Nicotiana tabacum
MGKARLVGIGMDYSATSKAALKWAIDNLIEEGDQIIIIHVASPKADPTNKQLFEDTGSPLIPLDEFREINVSKHYGLNPDKEVLNMLDTVSKVKKVTVVAKVYWGDAREKLCDAVEHLKLDTLVVGSRGLGVLKRVLLRSVSKYVVQNASCPVTVVKGSSLSCLSGICRK

SEQ ID NO: 14464 - protein, 163 aa, Unknown
  Sequence found in Organisms: Solanum tuberosum, Solanum phureja
MEGGGRFVGVAVDFSACSNKALKWAIDNILRKGDHLILVTVRPEGHYEEGEMQLWEATGSPLIPLSEICDGHTMKRYGVNPDPETLQMITLAARQMEITVVMKIFWGDAREKLCEAIDKTPLSCLVIGNRGLGKIKRAIMGSVSNYVVNNATCPVTVVKKAED

SEQ ID NO: 14465 - protein, 163 aa, Solanum melongena
MEGGGRFVGVAVDFSACSKTALKWAIDNILRKGDHLILVTVRPEGHYEEGEMQLWEATGSPLIPLTELCDGHTMKRYGVNPDPETLQIITLAARQMEITVVMKIFWGDARDKLCEAIDKTPLSCVVIGNRGLGKLKRAIMGSVSNYVVNNATCPVTVVKNADD

SEQ ID NO: 14466 - protein, 163 aa, Capsicum annuum
MEGGDRFVGVAVDFSACSKKALKWAIDNIIRKGDTLILVTVRPEGHYEESEMQLWVATSSPFIPLSELCDSHTMKRYGVNPDPETLQMISLAARQMEITVVMKIFWGDAREKLCEAIDRTPLSCLVIGNRGLGKIKRAIMGSVSNYVVNNATCPVTVVKKAED

SEQ ID NO: 14467 - protein, 162 aa, Nicotiana tabacum
MEGGRFVGVAVDFSACSKKALKWAIDNILRKGDHLILVTVRPEGHYEEGEMQLWEATGSPLIPLSEFCDAHTMKKYGVNPDPETLDMVTLAARQKEIMVVLKIYWGDAREKLCEAIDKTPLSCLVIGNRGLGKLKRAIMGSVSNYVVNNATCPVTVVKHADD

SEQ ID NO: 14468 - protein, 162 aa, Nicotiana benthamiana
MEGGRFIGVAVDFSACSKKALKWSIDNILRKGDHLILVTVRPEGHYEEGEMQLWEATGSPLIPLSEFCDAHTMKKYGVNPDPETLDMVTLAARQKEIMVVLKIYWGDAREKLCEAIDKTPLSCLVIGNRGLGKLKRAIMGSVSNYVVNNATCPVTVVKHADD

SEQ ID NO: 14469 - protein, 162 aa, Nicotiana benthamiana
MEGGRFVGVAVDFSACSKKALKWSIDNILRKGDHLILVTVRPEGHYEEGEMQLWEATGSPLIPLSEFCDAHTMKKYGVNPDPETLDMVTLAARQKEIMVVLKIYWGDAREKLCEAIDKTPLSCLVIGNRGLGKLKRAIMGSVSNYVVNNATCPVTVVKHADV

SEQ ID NO: 14470 - protein, 162 aa, Nicotiana tabacum
MEGGRFVGVAVDFSACSKKALKWAIDNILRKGDHLILVTVRPEGHYEEGETQLWEVTGSPLIPLSELCDAHTMKKYGVNPDPETLDMVTLAARQKEIMVVLKIYWGDAREKLCEAIDKTPLSCLVIGNRGLGKLKRAIMGSVSNYVVNNATCPVTVVKHADE

SEQ ID NO: 14471 - protein, 162 aa, Petunia hybrida
MEGERMVGVAVDFSACSRKALKWAIDNIVRKGDHLILVTVRPEGNYEQGEMQLWVATGSPFIPLSEICDAHTMDRYGVAPDPETKEMITLATRQKEIQVVMKIFWGDAREKLCEAIDKTPLSCLVIGNRGLGKLKRAIMGSVSNYVVNNATCPVTVVKNAED

SEQ ID NO: 14472 - protein, 162 aa, Unknown
  Sequence found in Organisms: Solanum tuberosum, Solanum phureja
MATAMGMMGSIGGCGAASASLFRLRNSAKKKTRNDKNGFRVSCVYSSSAVADPYKTLKIQPGASESEVRKAFRQLALKYHPDVCRGNNCGVQFHQINEAYDVVMSNLRGETRAELEMIEEYDDSNDESMRGMYEPDWDLWEEWMGWEGAGIRDYTSHVNPYI

SEQ ID NO: 14473 - protein, 162 aa, Solanum melongena
MATAMGVVGSIGGCGAASASLFRLRNSAKKKTRNNKNGFRVSCVYSSSAVADPYKTLKIQPGASESEVRKAFRQLALKYHPDVCRGNNCGVQFHQINEAYDVVMSNLRGETRAELEMINDDDSSNDESMRGMYEPDWDLWEEWMGWEGAGIRDYTSHVNPYI

SEQ ID NO: 14474 - protein, 162 aa, Capsicum annuum
MASAMGMLGGIGGCGAGSASLFRLRNSAKKKTKNNKNGFRVSCVYSPSAVADPYKTLRIQPGASESEVRKAFRKLALQYHPDVCRGNNCDVQFHQINEAYDVVMSNLRGETRAELEMIEEYDDSNDDSMRGMYEPDWDLWEEWMGWEGAGIRDYTSHVNPYI

SEQ ID NO: 14475 - protein, 160 aa, Nicotiana tabacum
MATAMGMLGGIGGCGAASASLFRLRNISKKKTKNNKNGFRVSCVSSTVADPYKTLRIQPGASESEVRKAFRQLALKYHPDVCRGNNCGVQFHQINEAYDVVMSNLRGETRAEMEIYEEYDDNNDESMRGMNEPDWDMWEEWMGWEGAGIRDYTSHINPYI

SEQ ID NO: 14476 - protein, 160 aa, Nicotiana benthamiana
MATAMGMLGGIGGCGAASASLFRLRNISKKKTKNNKNGFRVSCVSSTVADPYKTLRIQPGASESEVRKAFRKLALQYHPDVCRGNNCGVQFHQINEAYDAVMSNLRGETRAEMEIYEEYDDNNDESMRGINEPDWDMWEEWMGWEGAGIRDYTSHINPYI

SEQ ID NO: 14477 - protein, 162 aa, Petunia hybrida
MATAMGMLGSIGGCGSASASLFRLRNISKKKTKNNKNGFKVSCVYSSSTVADPYKTLRIQPGASESEVRKAFRQLALQYHPDVCRGNNCGVQFHQINEAYDVVMSNLRGETQSVDQMEIYEEYDDNDEMRGMNDPDWDLWEEWMGWEGAGIRDYTSHINPYI

SEQ ID NO: 14478 - protein, 160 aa, Nicotiana benthamiana
MASAMGMLGGIGGCGAASASYFRLRNISKKKNKNNKNEVRVSCVSSTVADPYKTLRIQPGASESEVRKAFRKLALQYHPDVCRGTNCGVQFHQINEAYDVVMSNLRGETRAEMEIYEEYDDSNDESMRGMNEADWDTWEEWMGWEGAGIRDYTSHINPYI

SEQ ID NO: 14479 - protein, 579 aa, Solanum phureja
CYCRLVSKCPLNYILYEPRISKGGFRWKASASNEVPVEKWKQDSIFIDRRGRFRHFDHKKVSRKRCGSLRGRGWKYGSGFVDGIFPVLSPIAQQILTFIKTEKDPERIWSSLDTLRPNNHTWDDLINVAVQFRLNKQWDLIILMCEWILCRSSFQADVICYNLLIEAYGQCSLVKKAESTYLALVDARCVPTEDTYAILLKSYSKCGMIEKAEAVFSEMRKNGLPPSALVYNAYIDGLMKGRNSQKALAIFDRMKRESCQPSTDTYTMLINLYGKENKSYMALKMFNEMKTQKCKPNICTYTALVNAFARSGLCEKAEEVFEELQEAGLEPDVYTYNALMEAYSRAGYPQGAAEIFSLMQHMGCEPDRASYNIMVDAYGRAGLHEDAQTVFDEMTRLGIAPTMKSYMLLISAYSRNSNVSKCEEIVNQMQISGVKLDTFLLNSMLNLYGRLGQFAKMEELLTVIEAGPYIADISTYNILINAYGRSGFIMKMEEVFQSLPAKNLKPDVVTWTSRLGAYSKKKQYQRCLEIFEEMIDEGCYPDGGTAKVLLSSCSSEDQIEQVTTVIRSMHKNVKTVELV

SEQ ID NO: 14480 - protein, 582 aa, Nicotiana benthamiana
FHLSYCRLVSRCPLNHILFEPRISKVGFRWKAKDSNNVPIEKWKQDSIFIDRRGRFRHFDHKKVSRKRCGSLRGRGWKYGSGFVDGIFPVLSPIAQQILTFVKKETDPERIWSSLDTLRPTNDTWDDIINVAVQLRINKQWDLIILVCEWILCRSSFQADVICYNLLIEAYGQSSLVKKAESTYLALLEARCVPTEDTYALLLKSYSKCGMLEKSEAVFSEMRKNGLPPSALVYNAYIDGLMKGRNSQKALVIFDRMKRESCQPSTDTYTMLINLYGKENKSYMALKVFNEMKTQKCKPNICTYTALVNAFARGGLCEKAEEVFEELQEAGFEPDVYTYNALMEAYSRAGYPQGAAEIFSLMQHMGCEPDRASYNIMVDAYGRAGLHEDAQTVFDEMKRLGIAPTMKSYMLLISAYSRNSNVSKCEEIVKRMQKEGVKLDTFLLNNMLNLYGRLGQFTKMEELLTVIEAGPYVADISTYNILINAYGRSGFIAKMEEIFHSLPAKNLKPDVVTWTSRLGAYSKKKQYQRCLEIFEEMIDEGCYPDGGTAKVLLSSCSSEDQIEQVTTVIRSMHKNVKTVQLV

SEQ ID NO: 14481 - protein, 192 aa, Solanum phureja
MEIKLYTRSIILIVVIAFLSVLPAALCIEDKCSACSAIAEELEHGLLKEKPRNHLDMRHRLDSKGQREGKLIDYRGSELRVVELLDDLCEKMQDYTLEKVDSSTNTWIKVNNWDLLKTNKQEARAHSKAMSSFCGRLLEQTEDELAELIKKGSVKVGDVTKVLCEDLSNYCKGTSSSNKAVDDEDKDTDREL

SEQ ID NO: 14482 - protein, 82 aa, Solanum tuberosum
MTWTAVLIQILVHSFCDSGTGRSWQEDGEIGQMEIKLYTRSIILIVVIAFLSVLPAALCIEDKCSACSAIAEELEHGLLKVR

SEQ ID NO: 14483 - protein, 185 aa, Nicotiana benthamiana
MRSILIVAFAFLSVLPATLCIEDKCAACTAIAEELEHGLLKEKPRNHLDMRHRLDSKGQREGKLIDYRASELRVVELLEDLCEKMQDYTLEKVDSSTKTWIKVNNWDLLKTNKQEARAHSKAISSFCGRLLEQTEDDFTELMKKGSVQVGDVSKVLCEDLSNYCNGKSSSNKTVGDENEDADREL

SEQ ID NO: 14484 - protein, 416 aa, Solanum phureja
MASLVQFLPLFPFFFLISFSVSHGPFLPKAIILPVNKDPSTFQYVTQLYMGANHLAPIKLVVNLGGSFLWADCGLTSDSSSQKLVPCNSLKCSMAKPNGCTNDNKICGLKSENPFTRLAATGELAEDMFAVEFIDELKTGSVASIHQFLFSCTSSTLLQGLARGAKGMLGLGNSRIALPSQLSDTFGFQRKFAICLSSSNGAIISGESPYLSLLSHDVSRSMLYTPLISSRDGVLEEYYINVKSLKINGNKLSLNTSLLTMDGEGHGGTKISTISPFTTMKTSIYKTFVESYERFGFSMGLTKVEPIAPFGLCFSTKVEGLNVPSIDLVLQSEMVKWRIYESNSMVKVSDEVMCLGFLDGGVNQKASIVIGGHQLEDNLLEFNLGTSMLGFTSSLAMVETSCSDFMFTKDSSVFDT

SEQ ID NO: 14485 - protein, 416 aa, Solanum tuberosum
MASLVQFLPLFPFFFLISFSVSHGPSLPKAIILPVNKDPSTSQYVTQLYMGANHLAPIKLVVNLGGSFLWADCGLTSDSSSQKLVPCNSLKCSMAKPNGCTNDNKICGLKSENPFTRLAATGELAEDMFAVEFIDELKTGSVASIHQFLFSCTSSTLLQGLARGAKGMLGLGNSRIALPSQLSDTFGFQRKFAICLSSSNGAIISGESPYLSLLSHDVSRSMLYTPLISFRDGVSEEYYINVKSLKINGKKLSLNTSLLTMDGEGHGGTKISTISPFTTMKTSIYKTFVEAYERFGFSMGLTKVEPIAPFGVCFSTKVEGLNVPSIDLVLQSEMVKWRIYESNSMVKVSDEVMCLGFLDGGVNQKASIVIGGHQLEDNLLEFNLGTSMLGFTSSLAMVETSCSDFMFTKDSSVFDT

SEQ ID NO: 14486 - protein, 165 aa, Solanum phureja
MENLLGLMRVRIHRGINLAIRDVTTSDPYVVVRMGKQKLKTRVVKKNLNPEWNEELTLSITEPILPINLHVYDKDIFSLDDKMGDAEIDIHPFIDAVRKRYKNIPSGTIITKIKPSRQNCLSEESPIVWENDQVVQNVFIRLRNVERGEIELQLQWIDIPGSKGV

SEQ ID NO: 14487 - protein, 165 aa, Solanum melongena
MENLLGLLRIRIRRGINLAIRDVTTSDPYVVVRMGKQKLKTRVVKKNLNPEWNEELTLSVTEPILPIKLQVYDKDTFSLDDKMGDAEVDILPFIDVVRKRFKNIPSGTIITKIKPSRQNSLSEESCIVWENDQIVQNVFVRLRNVERGEIELQLQWIDVPGSKGV

SEQ ID NO: 14488 - protein, 165 aa, Nicotiana benthamiana
MENLLGLLRIHIHRGINLAIRDVTSSDPYVVIRLGRQKLKTRVVKKNVNPEWNEDLTLSITEPIQPIKLQVYDKDIFSLDDKMGDAELDVFPFIDAVRKRFKNIPNGTIITKIKPSRENCFSEESCVVWENGQVVQNVFIRLRNVERGEIELQLQWIDIPGSKGL

SEQ ID NO: 14489 - protein, 151 aa, Nicotiana tabacum
GINLAIRDVTSSDPYVVVRLGRQKLKTRVVKKNVNPEWNEDLTLSITEPIQPIKLQVYDKDIFSLDDKMGDAELDIFPFIDAVRKRFENIPNGTIITKIKPSRENCFSEESCIVWENGQVVQNVFIRLRNVERGEIELQLRWIDIPNSKGL

SEQ ID NO: 14490 - protein, 326 aa, Nicotiana benthamiana
MASFFFSTKFFLLLFFVSAIPISFIIHLETSAPPTHVYHYHSTGWLRECAKWDDLNRRFIVSFFEGGLGVIPVDAGYSPGNELQEIPVVKDVDLTGNASLGLAIDRERNRVLVAVADVFGNRYSALAAYDLTSWNRIFLTKLSGPEDEKAFADDVVVDTEGNAYITDAKANKIWKVGVNGELKYTIKNPIFTPKEWYNKLVGLNGIAYHPNGYLLVAHTFSGNLYKIEIAKHDEVKLVKINGGSLKFGDGMELLSSTKLVVAGNPTRLVESSDDWESCSIVGKAKGAIHRLTTAATVKEGTVYLNHMIGLGYPRKKHVLVEAVFSA

SEQ ID NO: 14491 - protein, 326 aa, Nicotiana tabacum
  misc_feature (22)..(22): Xaa can be any naturally occurring amino acid
  misc_feature (37)..(37): Xaa can be any naturally occurring amino acid
  misc_feature (52)..(52): Xaa can be any naturally occurring amino acid
  misc_feature (74)..(74): Xaa can be any naturally occurring amino acid
  misc_feature (90)..(90): Xaa can be any naturally occurring amino acid
  misc_feature (99)..(99): Xaa can be any naturally occurring amino acid
  misc_feature (115)..(115): Xaa can be any naturally occurring amino acid
  misc_feature (145)..(145): Xaa can be any naturally occurring amino acid
  misc_feature (177)..(177): Xaa can be any naturally occurring amino acid
  misc_feature (197)..(197): Xaa can be any naturally occurring amino acid
  misc_feature (216)..(216): Xaa can be any naturally occurring amino acid
  misc_feature (256)..(256): Xaa can be any naturally occurring amino acid
MASFFCSTKFFLLLFFVSAIPXAFIIHLETSAPTTHXYHYHSTGWLRECAKXDDVNRRFIVSFFGGGLGVIPVXENYSPGNVLQEIPVVXDVDLTGNAXLGLTIDRERNRVLVAXADVFGNRYSALAAYDLTSWNRIFLTKLSGXEDEKAFADDVVVDTEGNAYITDAKANKIWKVXVNGELKYTIKNPIFTPKEWXNKLVGLNGIVYHPNGYLLXAHTFSGNLYKIEIAKGDEVKLVKINGGSLKFGDGMELLSXTKLVVAGNPTRLVESSDDWESCSIVGKAKGAIHRLTTAATVKEGTVYLNHMIGLGYPRKKHVLVEAVFSA

SEQ ID NO: 14492 - protein, 78 aa, Nicotiana benthamiana
FPIVTYLCTHTHLINNTQNTIFFSSPQKNTLNMASFFCSTKFFLLLFRISNSYCFYNPPRNFRPHNPRLSLPQHRVVT

SEQ ID NO: 14493 - protein, 355 aa, Solanum phureja
MEIIPTLPYDIGLECLIRVPYYNFSSVTSVSRNWKLQIELPEFWRRRRATGSTRQVILMAQARIDPRLKLGSFKYSAFSVYKLTLYEPESGYWAELPPVPGISDGLPMFCQLVGVGLNLVVMGGWNPLTWEPSNAVFVFSFVSATWRRGADMPGCRRSFFGCASDSERTVYVAGGHDEEKNALKSAMAYDVARDMWVPMPDMASERDECKCTFFQDKFHVIGGYDTSMQGQFGTSAESFDPSTWQWDQVNEHFFESATCPRTCVEGGDGKLYLCRDGDVLALGKSTWQAVAAIPVELRSVAFVTAWRGKILMTGSMGFNEPHNTYVLDLQSYKWTKMDTPANFSGHVQSGCCLEM

SEQ ID NO: 14494 - protein, 354 aa, Solanum tuberosum
ELIPTLPYDIGLECLIRVPYYNFSSVTSVSRNWKLQIELPEFWRRRRATGSTRQVILMAQARIDPRLKLGSFKYSAFSVYKLTLYEPESGYWAELPPVPGISDGLPMFCQLVGVGLNLVVMGGWNPLTWEPSNAVFVFSFVSATWRRGADMPGCRRSFFGCASDSERMVYVAGGHDEEKNALKSAMAYDVARDMWAPMPDMASERDECKCTFFQDKFHVIGGYDTSMQGQFGTSAESFDPSTWQWDQVNEHFFESATCPRTCVEGGDGKLYLCRDGDVLALGNSTWQAVAAIPVELRSVAFVTAWRGKILMTGSMGFNEPHNTYVLDLQSYKWTKMDTPVSFSGHVQSGCCLEM

SEQ ID NO: 14495 - protein, 356 aa, Nicotiana benthamiana
MELIPSIPYDIGLECLIRVPYHNFSSVTSVCKNWKQQIELPEFWKLRRATGFTRQVILMAQARTDDPKIKIGLSKYSAFPVYRLTLYEPDSGYWAELPPLPGNSDGLPMFCQPVGVGLSLVVIGGWNPITWEPSNAVFVYNFVTATWRRGDDMPGCRRSFFGCASDSERTVYVAGGHDEEKNALKSAMAYDVASDEWVPMPDMASERDECKCTFYQGKFHVIGGYDTSMQGRFGTTAESFNTSIWQWDPINEHFLDSATCPRTCVEGGDGNLYLCRDGDVLAFQDSTWQVAAAIPAELRNLAFVTAWRGKILMTGSMGFNEPHNTYILDLQNYKWTKMDTPVNFSGHVQSGCCLEM

SEQ ID NO: 14496 - protein, 188 aa, Solanum tuberosum
MSKEGRRRGVRWSWTSAFVGAAAAAATVMALSSKPRDPDFHLISIDLTSFKLNFPVVDAELILTVHVTNPNVTSINYSSTEMSIFYSGDHLGSARVKAGSQPPRSCQVLRLPARLSGLQLAHHGKEFVADVAKREMLLDATVDIEGFAKVMWWDHKFRVHVDSHVTVDPVFLDVIDQENKSALEVFVK

SEQ ID NO: 14497 - protein, 188 aa, Solanum phureja
  misc_feature (28)..(29): Xaa can be any naturally occurring amino acid
MSKEGRRRGVRWSWTSAFVGAAAAAAKXXALSSKPRDPDFHLISIDLTSFKLNFPVVDAELILTVHVTNPNVTSINYSSTEMSIFYSGDHLGSARVKAGSQPPRSCQVLRLPARLSGLQLAHHGKEFVADVAKREMLLDATVDIEGFAKVMWWDHKFRVHVDSHVTVDPVFLDVIDQENKSALEVFVK

SEQ ID NO: 14498 - protein, 186 aa, Solanum melongena
MSKQGRGRRWSWTSAFVGAATAALTVAALSVKPRDPDFHLISIDLTSFKLNFPVLDAELILTVHVTNPNVTSINYSSTEMLIFYSGDHLGSARVKAGSQPPRSCEVLRLPARLSGLQLAHHGKEFVADVAKREMLLDATVDIEGYAKVMWWDHKFRVHVDSHVTVDPVFLDVIDQENKSALEVFVR

SEQ ID NO: 14499 - protein, 188 aa, Nicotiana benthamiana
MSKEGSRRRGGWSWTSALVGAAAAGVAFSALSSKPRDPDFHLISIDLTSFKLNFPVLDAELILTVHVTNPNVTSITYSSTEMSIFYSGDHLGSARVKAGSQPPRSCQVLRLPARLSGVQLAHHGKEFLSDVAKREMVLDATVDIEGFAKVMWWDHKFRVHVDSHVTVDPIFFDVIDQENKSALEVFVR

SEQ ID NO: 14500 - protein, 188 aa, Nicotiana tabacum
  misc_feature (170)..(170): Xaa can be any naturally occurring amino acid
  misc_feature (172)..(172): Xaa can be any naturally occurring amino acid
MSKEGSRRRGGWSWTSALVGAAAAGMAVAALSSKPRDPDFHLISIDLTSFKLNFPVLDAELILTVHVTNPNVTSITYSSTEMSIFYSGDRLGSARVKAGSQPPRSCQVLRLPARLSGVQLAHHGKEFLSDVAKREMVLDATVDIEGFAKVMWWDHKFRVHVDSHVTVDPXFXDVIDQENKSALEVFVR

SEQ ID NO: 14501 - protein, 188 aa, Nicotiana benthamiana
MSKKGSRRRGGWSWTSALVGAAAAGIAMAALSSKPREPDFHLISIDLTSFKLNFPVLDAELILTVHVTNPNVTSLTYSSTEMSIFYSGDHLGSARVKARSQAPRSCQVLRLPARLSGVQLAHHGKEFLSDVAKRQMVLDATVDIEGFAKVMWWDHKFRVHVDSHVTVDPIYFDVIDQENKSALEVFVR

SEQ ID NO: 14502 - protein, 191 aa, Capsicum annuum
MSKGGRKTTSGGLRWSWTSALVGAATAAAAVAALSSKPRDPDFHLISIDLTSFKLKFPSVDAELILTVHVTNPNVTSITYSSTEMSIFYSGEHLGSARVKAGSQKPRSCQVLRLPARLNGGQLAQRGKQFVADVAKREMVLDATVDIEGFARVLWWDHKFRVHVDSHVTVDPVFLDVIDQENKSALEVFVR

SEQ ID NO: 14503 - protein, 676 aa, Solanum phureja
MELRCLQSLNIPPTGLAEKPFLCGQPITLIHTSTKRGPNSKNLKPLRFRAQISAKISSLEPQGTAKDVKSKDGNLVFVAGATGRVGSRTVRELLKLGFKVRAGVRSAQRAQPLVKSVEQIKIENTTDGGAKAIEKLEIVECDLEKSDQIRPALGDASIVICCIGASEKEIFDVTGPYRIDYLATKNLIDAATVAKVDHFILLTSLGTNKVGFPAAILNLFWGVLLWKRKAEEALLASGLPYTIVRPGGMERPTDSFKETHNITISEEDTLFGGLVSNLQVAELMAVMAKNRSLSYCKVVEVVAETTAPLTPMEDLLAKIPCQRVEVSPPKETGDLQKSATPSSTTSEIPDASLEKKPAETKLKAAAPLSPFTAYADLKPPTSPSPIPPGGRQEGTIGAEDSKPTKEASSVVDYAFDKAELLTTRPSSPYAAYEDLKPPTSPSPNPPGGHQEGASGAEDSEPTKAASSVVDSTFDKAELLTTRPLSPYIAYEDLKPPTSPSPNPSGGRQEGASRAEDSEPTKPASSVVDSTFDKAELLTTSYEDLKPPTSPSTNPPGGRQEGASGAENSKPTTEASSVYLFTFDKAELLTTRPLSPYTAYEDLKPPTSPSPRPSGLKSSATVEVTSPVTGGNDVAINSATNSAKEDSSKNSAFCHSPYPAYEDFKPPSSPTPSFNKM

SEQ ID NO: 14504 - protein, 548 aa, Nicotiana benthamiana
VEVGEANFNLHKFMLVAKSNYIRKLILESKETEVTRINLSEIPGGGPEMFEKSAKFCYGVNFEITVHNVAALRCAAEYLQMTDKYCDNNLASRTEDFLTQVALTSLSGALVVLKSCENLLPLAEELNIVQRCVEIASAKLTILDITVEANFPSRSPPNWWTEEFTILDITFFERIIISMKTRGAKALTAASAIITYTERSLRDLVRDHSGNGTRLVEPEDSDIRMHQRQLLESIVKLLPSDKAAFPINFLCCLLRTAIFLRAANSCKNELEKRISAILEHVTVDDLLVLSFTYDGERLFDLESVRRIISGFMEKEKTVAVFNGGDLGQQVCSTAMQRVAKTVDAYLGEIATFGDLTIAKFNGIAILVPKGARKADDDLYRAVDIYLKAHPNLDEIEREKVCSVMDTLKLSYEARVHASQNKRLPVQIVLHALYFDQLKIRSGGNDTSNLPEAMATRNQLQADVSLVKENEALRTELLKMKMYISDRQKTNQGTTSAKPSLSRKPTFFSSVSKRLGKLNPFKHGSKDTSMIDDATVDITKPRRRRFSIS

SEQ ID NO: 14505 - protein, 562 aa, Amsonia hubrichtii
SRLSLAMERTGQWVFSQEIPTDVIVVVGEANFSLHKFMLVAKSNYIRKIILESKEADLTRIDLSEIPGGPEIFEKAAKFCYGVNFEITVQNVAALRCAAEYLQMTDKYCDNNLAGRTEDFLRQVALTSFSSALVVLKSCEDLLPLAEELNIVPRCVDVVSSKACVEANFPSRSPPNWWTEELSILDISFFGKIISTMKSRGSKSLTVASAIIAYAEKSLWDLVRDHSGNGVKTNILDDSDIRIRQRELLESVVTLLPSEKAAFPINFLCCLLRAAIFLGAASSCKNELEKRISAILEHVTVDDLLVLSFTYDGERLFDLDSVRKIISGFVGKRKSVGVFNGGDFREVCSTAMLRVAKTVDAYLGEIATYADLSISKFNGIAILVPKGARKVDDDLYRAVDIYLKAHPNLDEIEREKVCSVMDALKLSYEARVHASQNKRLPVQIVLHALYYDQLKIRSGTEDQSMPNAITTRHQLKADSSLVKENEELRTELLRMKMYITDMQKSQGTSSKGLGKKSTFFSSMSKTLGKLNPFKHGSKDTSNIDDDGAVDTTKPRRRRFSIS

SEQ ID NO: 14506 - protein, 785 aa, Solanum phureja
MRSVRMDSNGPPTKRLVELNCHSIQDGQNGVRGGITGDGQGLSEEDESRINEDVEGGNETHRNLVQVQAVLQTQQQQPPGPLVRWERFLPLRSLKVLLVENDDSTRHVVSALLRNCSYEVIAVGYALEAWRILEDLTNHVDLVLTEVAMPYLSGVGLLSKIMNHKTLKNVPVIMMSANDSMGIVFKCLSKGAVDFLVKPIRKNELKNLWQHVWRKCHSSSGSGSESGIQTQKSTKSKSVEMSGNNTDSNDEAENGSFDLDDRDGSDNGSGTQSSWSKRAIEVDSPQPMSPWNELADPPDSTCAQVIHTRPEALSATWVPANATRKCLNEKDELGNARMGKDLNMGVTNVPELEGLSGKVMDGLAASIKDKHLELDPKDNENMGRNLKLNKETREDDLKDKDVGYMGDITNTCTPQVESMANEVPNDPFKITNIKEIATYDSQDMPSLELSLKQLRDVGENGTGVQERNILRHSDLSAFSRHVYNAASTANQAPTGNVGSCSPVNNCSEVAKAESIHNLRSKSNSTPNQCSNGSSNNNDMGSSTNNFFSKPNTLTDKPINKPAVNAHPCSAFQPVQHGHNSSLQAMVPRTQDTAKAAVSQARAMHQKFQVQHHHHHYHHHHHHVLNLQQRQQLLNNDDSSLRNDVEAAPDCGTSDMVGTPVEGNAANYGSASGSNNGSNGQNGSSGQNGSSTAVVAEGTNLVAENETGEKCEIGSGSGSGSASRSGDHLAQREAALIKFRQKRKERCFEKKVRYQSRKRLAEQRPRMRGQFVRQDADKSKSNNTNS

SEQ ID NO: 14507 - protein, 779 aa, Nicotiana benthamiana
MRGIRMDSNGPPTKGLVGLNCHSIQDGQNGVRDGITGEGQGLSEEDESRINEDVEGGNETQRDLVHVQAVLQTQQQQPQGPLVSWDRFLPIRSLKVLLVENDDSTRHVVSALLRNCSYEVTAVGNALEAWRILGDLANHVDLVLTEVAMPYLSGIGLLSKIMNHKTRKNVPVIMMSANDSMGIVFKCLSKGAVDFLVKPIRKNELKNLWQHVWRKCHSSSGSGSESGIQTQKSTKSKSVEGSLNNTDINDEAEHGSFDLDDRNGSDNGSGTQSSWSKRAIEVDSPQPMSPWNELADPPDSTCAQVVHSRPEALSATWVPATAPREYRNEKDELGNARMGKDLNIGVTSVPELEGRSGKPMDDLAAPTKDKHLELDPKGSEEMVRNLKHNKETREDDLKDMDVGYMGDHTKTGTPLVESMANEVPKDPSEITNIKEIATYDSKGMPSLELSLKQLLDVGETGTSVQERNILRHSDLSAFSRYNAPASNANQAPTGNVGSCSPVNNSSEVAKTESLLNLRSKSRSTPNQRSNGSSNNNDMGSSTNNFFVKQETLTDKPITKPAVNAHTCSAFQPVQHGHNSSLQPMVPGKQDAAKAALAQARAMQQQVQVQHHHHHYHHHHHHVLDLKQQQQLLDTDDSSMRNAVGAAPNFGTSDMVGTVEGNAANYGSASGSNNGSNGENGSSGQNGSSTALVAEGTNLVAENEAGEKCEIGSMSGSASRSDQSAQRVAALIKFRQKRKERCFEKKVRYQSRKRLAEQRPRVRGQFVRQDADKNKSNDDS

SEQ ID NO: 14508 - protein, 633 aa, Solanum lycopersicum
MPFLSGVGLLSKIMNHKTLKNVPVIMMSANDSMGIVFKCLSKGAVDFLVKPIRKNELKNLWQHVWRKCHSSSGSGSESGIQTQKSTKSKSVEMSGNNTDSNDEAENGSFDLDDRDGSDNGSGTQSSWSKRAIEVDSPQPMSPWNELADPPDSTCAQVIHSRPEALSATWVPANATRRCLNEKDELGNVRTVKDLNMGVANVPELEGLSGKVMDGLAASMKDKHLELDPKDNENMGRNLKLNKETREDDLKDKDVGYMGDITNTCTPQVESTANEVPNDPSKITNIKEIATYDSKDMPSLELSLKQLRDVGENGTGVQERNILRHSDLSAFSRYNAASTANQAPTGNVGSCSPVNNSSEVAKAESIHNLQSKSSSTPNQRSNGSSNNNDMGSSTNNFFIKPDTLIDKPTNKPAVNAHPCSAFQPVQHGHTSSLQAMVPGTQDTAKAAVGQARAVHQKFQVQHHHHHYHHHHHHVLSLQQRQQLLNADASSLRNAVETAPDCGTSDMVGTPVEGNAANYGSASGSNNGSNGQNGSSGQNGSSTAVVAEGTNLVAENETGEKCEIGSGSGSATRSGDHSAQREAALIKFRQKRKERCFEKKVRYQSRKRLAEQRPRMRGQFVRQDADKSKSNNTNS

SEQ ID NO: 14509 - protein, 182 aa, Solanum phureja
METLICLQIPNLSITNSFPLNQKFPIHFHKKINRIPNLQRTTWKLNAEAKGFGNGKPEISKKGNRRNNNDNDEKIPTEIWERIIGRILFYVGAPLIGGVILLQIFDIIKQQKLLDLPIWLPFLTTFITFGASALGAAYGTLSASWDPEKQGSFIGLEEAQKNWVDMWAEDGADEEEENRWIN

SEQ ID NO: 14510 - protein, 182 aa, Solanum tuberosum
MATLICLQIPNLSITNSFPLNQKLPIHFHKKINRIPNLQRTTWKLNAEAKSFGNGKPEISKKGNRRNNNDNDEKIPTEIWERIIGRILFYVGAPLIGGVILLQIFDIIKQQKLVDLPIWLPFLTTFITFGASALGAAYGTLSASWNPEKQGSFIGLEEAQKNWVDMWAEDGADEEEENRWIN

SEQ ID NO: 14511 - protein, 183 aa, Solanum melongena
METLIALQNPYLSTTNLFPLNQKIPIHFHKNINGVPNLHRTTWKLNAEAKGFGNGRLETSKKANRRNSNDDEDEKIPTEVWERIIGRILFYVGAPLVGGVILLQIFDIIKQQKLLDLPIWLPFLTTFITFGASALGAAYGTLSASWDPEKQGSFIGLEEAQKNWVDMWAEDGANDEEENRWIN

SEQ ID NO: 14512 - protein, 196 aa, Solanum phureja
MASTTYGGGLLCKTRVSISSFPLMQPKMRPEITYSQRHPRVGTSSLLRNVSHNMGMKKVPRMITRASSEPSGSSDGALGQDKTPFGYTRKDVLLIGVGVTLLGVGLKSGLEFLGFDPLQAGNVVQLVLVLGLTVGWISTYIFRVSNKEMTYAQQLRDYESKVMEKRLESLTEAELQVLLEQVEEEKTRLTSGEEVK

SEQ ID NO: 14513 - protein, 192 aa, Solanum tuberosum
MASTTYGGGLLCKSRVSSLMSISSFPLMQPKMRPEITYSQRHLRVGTSSLLRNVSHNMGMKKVPLMITRASSEPSGSSDGALGQDKTPFGYTRKDVILIGVGVTLLGVGLKSGLEFLGFDPLQAGNVVQLVLVLGLTVGWISTYIFRVSNKEMTYAQQLRDYESKVMEKRLESLTEAELQVLLEQVEEEKTA

SEQ ID NO: 14514 - protein, 200 aa, Capsicum annuum
MASIAYGSGFLCKTRAFSLVGISSFPLMEPGMRPEIAYSQRYLRVGTSPFLRNVSYNMGMKKVPLMITRASSKPSGSNDGALSQDKTPFGYTRKDVLLIGLGVTLLGIGLKSGLEYLGFDPLQAGNVVQLVLVLGLTVGWISTYIFRVSNKEMTYAQQLRDYESKVMEKRLESLTEAELQVLLEQVEEEKTRLTSGEEVK

SEQ ID NO: 14515 - protein, 203 aa, Nicotiana tabacum
  misc_feature (197)..(197): Xaa can be any naturally occurring amino acid
MGSTAYTGVYNSLLCKTRASSLMGISSFPLMEPIMRPEITNSQRHLRVGISPSLRNVSYNMGLKKVPLIITRASSKPSDSSDEALGQNKTPFGYTRKDVILIGVGVTLLGYGLKSGLEFLGFDPLQAGNVVQLVLVLGLTVGWISTYIFRVSNKEMTYAQQLRDYESKVMEKRLESLTEAELQVLLEQVEEEKSRLXSGKEVK

SEQ ID NO: 14516 - protein, 203 aa, Nicotiana benthamiana
MGSTAYTGVYSSLLCKTRASSSMGISSFSLMGPRIRPEITNFRRHLRVGVSPSLRNVSYNMGLKKVPLIMTRASSKPSGSSDEALGQNKTPFGYTRKDVILIGVGVTLLGYGLKSGLEFLGFDPLQAGNVVQLVLVLGLTVGWISTYIFRVSNKEMTYAQQLRDYESKVMEKRLESLTEAELQVLLEQVEEEKSRLASGKEVK

SEQ ID NO: 14517 - protein, 472 aa, Solanum tuberosum
MDMKVLKWQFLHGSLVKRLILKGFLFVTVMIVVSFVQMTHMIQKSEPIMLNFGVCPLNFGSNEYMNVTGFFKPVYGLRIPLFGASLMKRDDEKLTKNVFKELMENNFLDLNANALCVGKKSLYAALVLRELGLLSAVGVDAHPYFSLVWRRFMYELDHENNSFDFVFSRDLDKVTVPALMVLEIERVLRPGGTGVMLVGSSSFYAGNLIKGNLIRSATPVSLFLKSSDVVHVCGVGTYTLVMFKKRSEIVESLVHSVLPANCPSNVNNKPYLKHLEPLMEKKLGQFETQISYLPKFMNISSRNKLVYINVGAGEFVESTLARTFKPHYPIPHHLFNVFVIDHNTSALSLYVKNPGINFVYHPGLAVAGEATLPFVDTDEYLGAPLDHEGFDFIRWFSETVEDGDYVVLMMNARAAELNILAELFKTGSICHVDELFLRCSAVDCKNALCGDCMSLFKTLRRSGVFAHQWWGD

SEQ ID NO: 14518 - protein, 472 aa, Solanum phureja
MDMKVLKWQFLHGSLVKRLILKGFLFVTVMIVVSFVQMTHMIQKSEPIMLNFGVCPLNFGSNQYMNVTGFFKPVYGLGIPLFGASLMKRDDEKLTKNVFKELMEKNFLDLNANALCVGKKSLYAALVLRELGLLSAVGVDAHPYFSLIWRRFMYELDHDNNSFDFVFSRDLDKVTVPALMVLEIERVLRPGGTGVMLVGSSSFYAGNLIKGNLIRSATPVSLFLKSSDVVHVCGVGTYTLVMFKKRSEIVESLVHSVLPANCPSNVNNKPYLKHLEPLMEKKLGQFETQISYLPKFMNISSRNKLVYINVGAGEFVESTLARTFKPHYPIPHHLFNVFVIDHNTSALSLYVKNPGINFVYHPGLAVAGEATLPFVDTDEYLGAPLDHEGFDFIRWFSETVKDGDYVVLMMNARAAELNILAELFKTGSICHVDELFLRCSAVDCKNALCGDCMNLFKTLRRSGVFAHQWWGD

SEQ ID NO: 14519 - protein, 470 aa, Nicotiana benthamiana
MDMKVLKWQILHGSVVKRLILKGFLFVTVMIAVSFIQMGHLIRNSEPMLLNFGVCPLNFGSSPNMNVTGVFKPVSGLAFPFFGVALVKCEDENLSKNVFKELMEKNFLDLNAKALCVGKKSSAAALALRELGLSNAIGVDRHPYFSLLWRRFVYELDYEDNSFDFVFSRDLDRVSVPALLVLEIERVLRPGGTGAMLVSSSSFYSGNLIKGNLIRSATPVSSFLKSSDVVHVCGVGSFTLVMFKKRSEIVESLERSVLPANCPSTTNNKLFLKYLEPLVEKRSGQFETEISYLPKFMNISSRNKLVYINIGAGEFVETSVARMFKPHYPIPHHFFNVFVIDHNTSALPLYVKNPGINFVYHPGLGGEDASPFLDSDEYLSAPLDHEGFDFIPWFSETVEDGDYVVLMMNARTAELNILAELFKTGSICHVDELFLRCSAADCKNALCGDCISLFITLRGSGVFAHQWWGD

SEQ ID NO: 14520 - protein, 261 aa, Solanum phureja
MASLSGLSEELGEIEGQILDIFRALSNGFQKLEKIKDSNRQSRQLEELTGKMRECKRLIKEFDREVKDLEYKSDAETTKMLSEKKQSMIKELNSYVALKKQYASNIENKRVDLFEGPGEGFAEENGLLASNMSNQQLMDQGNRMMDETDEAIERSKKVVHETVNVGTETAAALKAQTEQMSRIVNELDSIHFSIKKATQLVKELGRQVATDRCIMALLFLIVIGVIAIIIVKIVNPHNKDIRDIPGLAPPAPSRRLLAYPY

SEQ ID NO: 14521 - protein, 261 aa, Nicotiana benthamiana
MASLTGVSEELGEIEGQISDIFRALSNGFQKLEKIKDSNRQSRQLEELTGKMKECKRLIKEFDREVKDLEYKNDADTTKMLNEKKQSMIKELNSYVALKKQYASNIENKRVDLFEGPGEGFAEENGLLASNMSNQQLMDQGNRMMDETDQVIERSKKVVHETVNVGTETAAALKAQTEQMSRIVNELDSIHFSIKKATQLVKELGRQVATDRCIMGLLFLIVVGVIAIIIVKIVNPHNKDIRDIPGLAPPAPSRRLLAYPY

SEQ ID NO: 14522 - protein, 263 aa, Nicotiana benthamiana
MASLTGVSEELGLGEIEGQISDIFRALSNGFQKLEKIKDSNRQSRQLEELTGKMKECKRLIKEFDREVKDLEYKNDADITKMLNEKKQSMIKELNSYVALKKQYASNIENKRVDLFEGPGEGFAEENGLLASNMSNQQLMDQGNRMMDETDQVIERSKKVVHETVNVGTETAAALKAQTEQMSRIVNELDSIHFSIKKATQLVKELGRQVATDRCIMGLLFLIVVGVIAIIIVKIVNPHNKDIRDIPGLAPPAPSRRLLAYPY

SEQ ID NO: 14523 - protein, 261 aa, Olea europaea
MDSLSGVSEELAEIEGQISDIFRALSNGFQKLEKIKDSNRQSRQLEELAAKMRECKRLIKEFDRESKDLEYKNDSGTNKMLSEKKQSMIKELNSYVALKKQYTSNLDNKRVNLFEGPGEGFAEENVLLASDMTNQQLMDQGNQMMDETDQAIERSKKVVHETIDVGTETATALKAQTEQMSRIVNELDSIHFSIKKASQLVKEIGRQVATDRCIMALLFLIVVGVLAIIIVKIVNPNNKDIRDIPGLAPPAPSRKLLWNPK

SEQ ID NO: 14524 - protein, 207 aa, Ipomoea nil
MASLSAISEELAEIEGQISDLFRALSNGFQKLEKVKDSNRQSRMLEELTEKMRECKRLIKEFDREVKDLEHRNDANTNKILAEKKQSMIKELNSYVALKKQYAANRDNKRVDLFEGPSEGFAEENDLLASNMTNQQLMDHGNRMMDETDQAIDRAQKVVHETVNVGTETAAALKAQTEQMSRIVNELDSIHFSIKKASQLVKEIGCN

SEQ ID NO: 14525 - protein, 261 aa, Plantago ovata
MSSLSAVSEELAEIEGQISDIFRVLSNGFQKLEKIKDSNRQSRQLEELTDKMRECKRLIKEFDREVKDQGYKSDPDTTKMLNEKKQSMIKELNSYVALKKQYASSLDNKRVDLFEGPGEGFQEDNTLLASNMTNQQLMDQGNHMMDETDQAIDRAKKVVHETIDVGTETAAALKAQTEQMSRIVNELDSIHFSIKKASQLVKELGRQIATDRCIMGLLFLIVIGVIAIIIVKIVNPGNRDIRDIPGLAPPAPARKLLWTRQ

SEQ ID NO: 14526 - protein, 225 aa, Olea europaea
MDSLLGVNEELAEIEGQISDIFRALSNGFQKLEKIKDSNRQSRQLEELTAKMRDCKRLIKEFDRESKDSEYKNDSDTNKMLSEKKQTMIKELNSYVALKKQYTSNLENKRVDLFEGPGEGFAEENVLLVSNMTNQQLMDQGNQMMDETDQAIERSKKVVHETIDVGTETAAALKSQTEQMSRIVNELDSIHFSIKKASQLVKEIGRQVATDRCIMALLFLLWLVS

SEQ ID NO: 14527 - protein, 262 aa, Centaurea maculosa
MASSISAISEELGEIDGQIADIFRALSNGFQKFDKIKDSSRQSRQLEELTGKMRECKRLIKEFDREVKELERTVDPDTSKILNEKKQSMVKELNSYVALKKQYANNIENKRVELFEGPGEGFAEDNGLLASSMTNQQLMDQGHNMMDETDHAIERSKKVVHDTVNVGTETAAALKAQTEQMSRIVNELDSIHFSIKKASQLVKEIGRQVATDRCIMALLFLIVIGVITIIIVKLVHPDNKDIRDIPGLAPPAPSRKLLWIPD

SEQ ID NO: 14528 - protein, 262 aa, Cirsium arvense
MASSISAISEELGEIDGQIADIFRALSNGFQKFEKIKDSSRQSRQLEELTGKMRECKRLIKEFDREVKDLEHTVDPDTSKILNEKKQSMVKELNSYVALKKQYANNIENKRVELFEGPSEGFAEDNGLLASSMTNQQLMDQGNQMMDETDHAIERSKKVVHDTVNVGTETAAALKAQTEQMSRIVNELDSIHFSIKKASQLVKEIGRQVATDRCIMALLFLIVVGVISIIIVKLVHPNNKDIRDIPGLAPPAPSRKLLWILD

SEQ ID NO: 14529 - protein, 263 aa, Lactuca sativa
MASSISAISEELGEIDGQIADIFRALSNGFQKFEKIKDSSRQSRQLEELTGKMRECKRLIKEFDREVKDLEHTVGPDTSKILNEKKQSMVKELNSYVALKKQYASNIENKRVDLFGGPAEGFEEDNNGLLASSMTNQQLMDNGHHMMDETDQAIERSKKVVHETVNVGTETAAALKAQTEQMSRIVNELDSIHFSIKKASQLVKEIGRQVATDRCIMALLFLIVVGVIAIIIVKIVDPNNKDIRDIPGLAPPAPSRKLLWIPE

SEQ ID NO: 14530 - protein, 262 aa, Cichorium intybus
MASSISAISEELGEIDGQIADIFRALSNGFQKFEKIKDPSRQSRQLEELTGKMRECKRLIKEFDREVKDLEHTISPDNSKILNEKKQSMVKELNSYVALKKQYASNIENKRVDLFGGPAEGFEEDNGLLASSMTNQQLMDNGHQMMDETDQAIERSKKVVHETVNVGTETAAALKAQTEQMSRIVNELDSIHFSIKKASQLVKEIGRQVATDRCIMALLFLIVVGVIAIIIVKLVHPDNKDIRDIPGLAPPAPSRRLLWIPD

SEQ ID NO: 14531 - protein, 262 aa, Gerbera hybrid cultivar
MASSISAISEELGEIDGQIADIFRALSNGFQKFEKIKDSSRQSRQLEELTGKMRECKRLIKEFDREVKDLDHTVDPDTSKILNEKKQSMVKELNSYVALKKQYASNIENKRVDLFEGAAEGFAEDNGLLASSMTNQQLMDHGNQMMDETDQVIERSKKVVHDTVNVGTETAAALKAQTDQMSRIVNELDSIHFSIKKASQLVKEIGRQVATDRCIMALLFLIVVGVIAIIIVKLVHPNNKDIRDIPGLAPPAPSRKLLWIPN

SEQ ID NO: 14532 - protein, 260 aa, Tabernaemontana elegans
MSTLSGISEELAEIEGQISDIFRALSNGFQKLEKIKDANRQSRQLEELTGKMRECKGLIKEFDRELKDLDYKNDPETNKMLNERKQSMIKELNSYVALKKQYASSLENKRVELFEGPGEGFAEENVLLASSMTNQQLMDHGNKMMDETDQIIERSKKVVHDTVDVGTETAAALKAQTEQMSRIVNELDSIHFSIKKASQLVKEIGRQVATDRCIMALLFLIVLGVIAIIIVKIVNPHNKDIRDIPGLAPPRPYSKVTLET

SEQ ID NO: 14533 - protein, 182 aa, Lippia dulcis
MLTEKKQSMIKELNSYVALKKQYASNLENKRVDLFEGTGEGFVDENVLLASNMTNQQLMDHGNHMMDETDQAIDRAQKVVHSTIDVGTETAAALKAQTEQMSRIVNELDSIHFSIKKASQLVKEIGRQVATDRCIMALLFLIVAGVIAIIIVKIVNPHNKDIRDIPGLAPPAPPRRLLWSTD

SEQ ID NO: 14534 - protein, 256 aa, Ocimum basilicum
MASEELAEIEGQIQDIFRALSNGFQKLEKIKDPSRRSRQLEELTDKMRECKRLIKDYDREQKDSEYKHDPSTNKMLTEKKQSMIKELNSYVALKKQYASNLENKRVDLFEGPGEGFAEDNVLLASNMTNQQLMDHGNHMMDETDQAIDRAKKVVHETVNVGTETAAALKAQTEQMSRIVNELDSIHFSIKKASQLVKEIGRQVATDRCIMGLLFLIVVGVITIIIVKIVNPHNKDIRDIPGLAPPAPTRKLLWIPN

SEQ ID NO: 14535 - protein, 256 aa, Mimulus guttatus
MASEELAEIEGQISDIFRALSNGFQKLEKIKDSSRQSRQLEELTDKMRECKRLIKEFDRELKDSDYKNDPNTNKMLTEKKQSMIKELNSYVALKKQYASNLENKRVDLFEGPGEGFVEENVLLASDMNNQQLMDHGNQMMDETDQAIDRAKKVVHETIDVGTETAAALKAQTEQMSRIVNELDSIHFSIKKATKLVKEIGRQVATDRCIMALLFLIVIGVVTIIIVKIVNPQNKDIRDIPGLAPPAPARKLLWISD

SEQ ID NO: 14536 - protein, 261 aa, Flaveria ramosissima
MASSISAISEELGEIDGQIADIFRALSNGFQKFEKIKDPSRQSRQLEELTGKMRECKRLIKEFDREVKELENTVDPDTSKMLNEKKQSMVKELNSYVALKKQYATNIQNKRVDLFGGPAEGFEEDNGLLASSMTNQQLMDNGHQMMNETDQAIERSKKVVHETINVGTETAAALKAQTEQMSRIVNELDSIHFSIKKASQLVKEIGRQVATDRCIMALLFLIVVGVIAIVIVKLVHPDNKDIRDIPGLAPPANRRLLWIPA

SEQ ID NO: 14537 - protein, 261 aa, Panax ginseng
MASLSAISEELAELDEQVTDIFRVLSNGFQKLEKIKDSNRQSRQLEELTDKMRECKRLIKEFDREVKDMEYSNDANTNKMLTEKKQSMVKELNSFVALKKQYASNLENKRADLFEGPDNGPAEDNGLLASSMTNQQLMGHGNQMMDETDQAIERSKKVVHDTVNVGTETAAALKAQTEQMSRIVNELDSINFSIKKASQLVKEIGRQVATDRCIMALLFLIVIGVIAIIIVKLLNPHNKDIRDISGLAPPVPSRKLLWNMN

SEQ ID NO: 14538 - protein, 262 aa, Echinacea purpurea
MASSISSISEQLGEIDGQIADTFRALSNGFQKFEKIKDASRQSRQLEDLTGKMRECKRLIKEFDREVKELENTVDPDTSKILNEKKQSMVKELNSYVALKKQYATNIQNKRVDLFGGPTEGFEEDNGLLASSMTNQQLMDNGHQMMDETDQAIERSKKVVHETVNVGTETAAALKAQTEQMSRIVNELDSIHFSIKKASQLVKEIGRQVATDRCIMALLFLIVVGVISIIIVKLVHPNNKDIRDIPGLAPPAPNRRLLWLPD

SEQ ID NO: 14539 - protein, 262 aa, Arnica chamissonis
MASSISAISEELGEIDGQIADIFRALSNGFQKFEKIKDSSRQSRQLEDLTGKMRECKRLIKEFDREVKELEHTVDPDTSKILNDKKQSMVKELNSYVALKKQYATNIQNKRVDLFGGPAEGFEEDNGLLASSMTNQQLMDNGHQMMDETDQAIERSNKVVHETINVGTETAAALKAQTEQMSRIVNELDSIHFSIKKASQLVKEIGRQVATDRCIMALLFLIVVGVIAIIIVKLVHPGNKDIRDVPGLAPPAPNRRLLWIPD

SEQ ID NO: 14540 - protein, 262 aa, Valeriana officinalis
MGSLSGISEELAEIDGKISDTFRALSNGFQKLEKIKDSNRKSRQLEELTDKMRECKRLIKEFDREVKDLEHNNDPDTKKILNEKKQSMVKELNSYVALKKQYANNLDNKRVDLFEGPGVEGFGEENVMLASSMTNQQLVDQGTHLMDETDQAIERSKKTVHETVNVGTETAAALKSQTEQMSRIVNELDSIHFSIKKASQLVKEIGRQVATDRCIMAFLFLIVVGVIAIIIVKIVHPNNKEIRDIPGLAPPVPARKLLWYPN

SEQ ID NO: 14541 - protein, 254 aa, Sesamum indicum
MASEELAEIEGQISDIFRALSNGFQKLEKIKEPNRQSRQLEELTDKMRECKRLIKEFDRELKETDYKNDPDTSKMLNEKKQSMIKELNSYVALKKQYASQNKRVDVFEGPGEGFAEENVLLASNMSNQQLMDHGNRMMDETDQAIDRAKKVVLDTIDVGTETAAALKAQTEQMSRIVNELDSIHFSLKRASQLVKEIGRQVATDRCIMALLFLIVMGVIAIIIVKIVNPNNKDIRDIPGLAPPAPARKLLWSSD

SEQ ID NO: 14542 - protein, 256 aa, Triphysaria pusilla
MVNEELAEIEGQISDIFRALSNGFQKLEKIKDSSRQSRQLEELTDKMRECKRLIKEFDRELKESDYKNDPDTNKMLTEKKQSMIKELNSYVALKKQHASNLENKRVDLFEGPGEGFVEENGLLASNMSNQQLVDHGNQMMDETDQAINRAQKVVHDTIDVGTETAAALKSQTEQMSRIVNELDSIHFSIKKASKLVKEIGRQVATDRCIMALLFLIVIGVVAIIIVKIVNPNNQDIRDIPGLAPPAPTRKLLWVPK

SEQ ID NO: 14543 - protein, 261 aa, Cucumis sativus
MDTLSSISEELADIEGQINDIFRALSNGFQKLEKIKDSNRRSRQLEELTDKMRECKRLIKDFDREVKDLEGGNNANTNKMLSEKKQSMIKELNSYVALKKQHASTLDNKRIDLFDGPGESYGEENVLLASNMTNQQLIDNGNRMMDETDEAIERSKKVVQETVNVGTETAAALKAQTDQMSRIVNELDSIHFSLKKASKLVKELGRQVATDKCIMALLFIIVIGVIAIIIVKLVNPNNKDIRDIPGLAPPVQSRKLLWNSG

SEQ ID NO: 14544 - protein, 262 aa, Helianthus annuus
MAVSISSISEELGEIDGQIADIFRALSNGFQKFEKIKDASRQSRQLEDLTVKMRECKRLIKEFDREVKELEHTVDPDTSKILNEKKQSMVKELNSYVALKKQYATNIQNKRVDLFGGPAEGFEEDNGLQASSMTNQQLMDNGHQMMDETDQAIERSKKVVHETINVGTETAAALKAQTEQMSRIVNELDSIHFSIKKASQLVKEIGRQVATDRCIMALLFLIVVGVISIIIVKLVHPNNKDIRDIPGLAPPAPSRRLLWISE

SEQ ID NO: 14545 - protein, 256 aa, Triphysaria pusilla
MVNEELAEIEGQISDIFRALSNGFQKLEKIKDSSRQSRQLEELTDKMRECKRLIKEFDRELKESDYKNDPDTNKMLTEKKQSMIKELNPYVALKKQHASNLENKRVDLFEGPGEGFVEENGLLASNMSNQQLVDHGNQMMDETDQAINRAQKVVHDTIDVGTETAAALKSQTEQMSRIVNELDSIHFSIKKASKLVKEIGRQVATDRCIMALLFLIVIGVVAIIIVKIVNPNNQDIRDIPGLAPPAPTRKLLWVPK

SEQ ID NO: 14546 - protein, 261 aa, Citrullus lanatus
MDSLSSISEELADIEGQINDIFRALSNGFQKLEKIKDSTRRSRQLEELTDKMRECKRLIKEFDREVKDLEGRNNSNTNKMLSEKKQSMIKELNSYVALKKQHASTLDNKRIDLFDGPGESYGEENVLLASNMTNQQLIDKGNRMMDETDEAIERSKKVVQETVNVGTETAAALKAQTEQMSRIVNELDSIHFSLKKASKLVKELGRQVATDKCIMALLFIIVLGVIAIIIVKLVNPNNKDIRDIPGLAPPVQSRKLLWNSG

SEQ ID NO: 14547 - protein, 261 aa, Flaveria ramosissima
MASSTSAISEELGEIDGQIADIFRALSNGFQKFEKIKDPSRQSRQLEELTGKMRECKRLIKEFDREVKELENTVDPDTSKMLNEKKQSMVKELNSYVALKKQYATNIQNKRVDLFGGPAEGFEEDNGLLASSMTNQQLMDNGHQMMNETDQAIERSKKVVHETINVGTETAAALKAQTEQMSRIVNELDSIHFSIKKASQLVKEIGRQVATDRCIMALLFLIVVGVIAIVIVKLVHPDNKDIRDIPGLGPPANRRLLWIHD

SEQ ID NO: 14548 - protein, 262 aa, Echinacea purpurea
MASSISSISEQLGEIDGQIADTFRALSNGFQKFEKIKDASRQSRQLEDLTGKLRECKRLIKEFDREVKELENTVDPDTSKILNDKKQSMVKELNSYVALKKQYATNIQNKRVDLFGGPTEGFEEDNGLLASSMTNQQLMDNGHQMMDETDQAIERSKKVVHETVNVGTETAAALKAQTEQMSRIVNELDSIHFSIKKASQLVKEIGRQVATDRCIMALLFLIVVGVISIIIVKLVHPNNKDIRDIPGLAPPAPNRRLLWLPD

SEQ ID NO: 14549 - protein, 210 aa, Ambrosia trifida
MRECKRLIKEFDREVKELEQTVDPDTSKILNEKKQSMVKELNSYVALKKQYATNIQNKRVDLFGGPAEGFEEDNGLQASSMTNQQLMDNGHHMMDETDQAIERSKKTVHETINVGTETAAALKAQTEQMSRIVNELDSIHFSIKKASQLVKEIGRQVATDRCIMALLFLIVVGVISIIIVKLVHPNNKDIRDIPGLAPPAPSRRLLWIPD

SEQ ID NO: 14550 - protein, 261 aa, Flaveria ramosissima
MASSISAISEELGEIDGQIADIFRALSNGFQKFEKIKDPSRQSRQLEELTGKMRECKRLIKEFDREVKELENTVDPDTSKMLNEKKQSMVKELNSYVALKKQYATNIQNKRVDLFGGPAEGFEEDNGLLASSMTNQQLMDNGHQMMNETDQAIERSKKVVHETINVGTETAAALKAQTEQMSRIVNELESIHFSIKKASQLVKEIGRQVATDRCIMALLFLIVVGVIAVVIVKLVHPENKDIPDIPGLAPPANRRLLWILD

SEQ ID NO: 14551 - protein, 261 aa, Citrus sinensis
MDLSSISDDLAEINGQITDIFRALSNGFQKLEKIKDVNRQSRQLEELTDKMRECKRLIKEFDREVKDIEGRNDPETNKMLSEKKQSMVKELNSYVALKKQHQTNLENNKRVDLFDGPNEGFAEDNVLLASSMTNQQLMDSGNRMMDETDQAIERSKQVVHETINVGTETAAVLKAQTEQMSRIVNELDSIHFSIKKASQLVKEIGRQVATDKCIMAMLFLIVIGVIAIIIVKLVNPNNKDIRDIPGLAPPAMARRLLSNPR

SEQ ID NO: 14552 - protein, 261 aa, Vitis vinifera
MSSLAGISEELAEIDGQISDIFRALSNGFQKLEKIKDTSRQSRQLEELTGKMRECKRLIKEFDREVKDLEIRNDPETNKMLNEKKQSMIKELNSYVALKKQYATNLENKRIDLFDAPADDVGEENVLLASSMTNQQLMDNGNRMMDETDQVIERSKKVVQDTVNVGTETAAALKSQTEQMSRIVNELDSIHFSIKKASQLVKEIGRQVATDRCIMALLFILVIGVIAVIIVKLVNPNNKDIRDVPGLAPPALTRKLLWHPN

SEQ ID NO: 14553 - protein, 178 aa, Flaveria ramosissima
MRKTINGQRVEFIRCTKKQYATNIQNKRVDLFGGPAEGFEEDNGLLASSMTNQQLMDNGHQMMNETDQAIERSKKVVHETINVGTETAAALKAQTEQMSRIVNELDSIHFSIKKASQLVKEIGRQVATDRCIMALLFLIVVGVIAIVIVKLVHPDNKDIRDIPGLAPPANRRLLWIHD

SEQ ID NO: 14554 - protein, 261 aa, Chenopodium quinoa
MSSLSAISEELGEIDGQINDIFRALSNGFQKLEKIKDSSRQSRQLEELTDKMRECKRLIKEFDREVKNLESRNDPNTSKTLNERKQSMIKELNSYVALKKQYASNLENKRVELFDGPSEGVGEENVLLASTMTNEQLMDRGNTMMDETDQAIDRGKKIVHETINVGTETAEALKAQTDQMSRIVNELDSINFSIKKASKLVKEIGRQVATDKCIMALLFLIVLGVIAIIIAKIINPHNKDIRDIPGLAPPAQSRRLLSFPN

SEQ ID NO: 14555 - protein, 139 aa, Eschscholzia californica
MDLSDISDELAHIDGQISDIFRALSNGFQKLEKIKDSNRQSRQLEELTGKMRECKRLIKEFDREVKDGESRNGPDTNRMLNEKKQSMIKELNSYVALKKQYASTLDNKRVDLLMGLVVEKNLVKKCSAGFNYEQSAANR

SEQ ID NO: 14556 - protein, 261 aa, Citrus clementina
MDLSSISDDLAEINGQITDIFRALSNGFQKLEKIKDVNRQSRQLEELTDKMRECKRLIKEFDREVKDIEGRNDPETNKMLSEKKQSMVKELNSYVALKKQHQTNLENNKRVDLFDGPNEGFAEDNVLLASSMTNQQLMDSGNRMMDETDQAIERSKQVVHETINVGTETAAVLKAQTEQMSRIVNELDSIHFSIKKASQLVREIGRQVATDKCIMAMLFLIVVGVIAIIIVKLVNPNNKDIRDIPGLAPPAMARRLLSNPR

SEQ ID NO: 14557 - protein, 262 aa, Gossypium hirsutum
MDPLAAVSEELAEIDGQVADIFRALSNGFQKLEKIKDVNRQSRQLEELTDKMRECKRLIKEFDREVRETERRTDANTHKMLNEKKQSMIKELNSYVALKKQHQSNLENNKRVDLFDGPSEGFGEENVLLASSMTNQQLMDSGNHMMDETDQAIDRAKKVVQDTVDVGTETAAALKAQTEQMSRIVNELDSIHFSIKKASKLVKEIGRQVATDKCIMALLFLIVIGVIAIIIVKLVNPNNKDIRDIPGLAPPAMNRRLLWTPN

SEQ ID NO: 14558 - protein, 200 aa, Ambrosia trifida
MASSISNISEELGQIDGQIADIFRALSNGFQKFEKIKDPSRQSRQLEDLTGKMRECKRLIKEFDREVKELEHTVDPDTSKILNEKKQSMVKELNSYVALKKQYATNIQSKRVDLFGGPAEGFEEDNGLQASSMTNQQLMDNGHNMMDETDQAIERSKKTVHETINVGTETAAALKAQTEQMSRIVMNLIQSIFQSRRLLN

SEQ ID NO: 14559 - protein, 128 aa, Flaveria ramosissima
MASSISAISEELGEIDGQIADIFRALSNGFQKFEKIKDPSRQSRQLEELTGKMRECKRLIKEFDREVKELENTVDPDTSKMLNEKKQSMVKELNSYVALKNNMQPTFRTSVLISLVGQLKDLKKIMAY

SEQ ID NO: 14560 - protein, 260 aa, Cannabis sativa
MDPLSSISEELAEIEGQISDIFRALSNGFQKLEKIKDSNRQSRQLEELTEKMRECKRLIKEFDREVKDIESRNDPNTNRMLSEKKQSMIKELNSYVALKKQYTANLDNKKIDLFDGPTEGHDEENVLLASNMTNQQLMDNGHQMMNETDQAIERSKKVVQDTINVGTDTAAALKAQTEQMSRVVNELDSIHFSIKKASQLVKEIGRQVATDKCIMALLFLIVVGVIAIIIVKLVNPNNKTIRDIPGLAPPAGRKLLWYLT

SEQ ID NO: 14561 - protein, 268 aa, Papaver somniferum
MDLSSISDELAEIDGQISDIFRALSNGFQKLEKIKDSSRQSRQLEELTGKMRECKRLIKEFDREVKDGEHSYGPDENKLLTEKKQSMIKELNSYVALKKQYASTLDNKRVDLFDGPGGGEGYGEENVLLASNMSNHQLIDSGNRMMDDTDQAIERSKKVVEDTVNVGAETAAALKAQTEQMSRIVNELDSIHFSIKKASQLVKEIGRQVATDKCIMAFLFLIVIGVVAIIIVKIVHPNNKDIRDIPGLGPPVQSRKLLWLPDNVYYSK

SEQ ID NO: 14562 - protein, 272 aa, Ricinus communis
MDPISAVSEELGQIDGQIADIFRALSNGFQKLEKIKDVNRQSRQLEELTGKMKDCKRLIKDFDREVKDLENRNDPNTNRMLNEKKQSMIKELNSYVALKKQYAANLENNKRVDLFDGPGEELNEENVLLASSMTNQQLMDNGNQMMDETDQAIERGKKIVQETINVGTDTAAALKAQTEQMSRIVNELDSIHFSIKKASQLVKEIGRQVATDKCIMAMLFLIVAGVIAIIIVKLVNPNNKDIRDIPGLAPPAQNRRLLWHPNKESSYNGAAL

SEQ ID NO: 14563 - protein, 266 aa, Populus trichocarpa
MDPLSSISEELAEINGQIADIFRALSNGFQKLEKIKDVNRQSRQLEELTGKLRECKRLIKEFDREMKDMESRNDPDTNKMLNEKKQSMIKELNSYVALKKQYATNLENNKRVDLFDGPNEELHDDNVLLASSMTNQQLVDHGNQMMDETDQAIERGKKVVQDTINVGTETAAALKAQTEQMSRIVNELDSIHFSIKKASQLVKEIGRQVATDKCIMALLFLIVVGVIAIIIVKLVNPSNKDIRDIPGLAPPAPSRRLLWIPNQETS

SEQ ID NO: 14564 - protein, 261 aa, Unknown
  Sequence found in Organisms: Prunus persica, Prunus mume
MDPLSAISEELAEIDGQITDIFRALSNGFQKLEKIKDSNRQSRQLEELTDKMRDCKRLIKEFDREVKNIERVNDPDTSRMLNEKKQTMIKELNSYVALKKQYASNLENKKIDLFDGPAEEYGEQNVLLASSMTNQQLIDNGNQMMDETDQAIERSKKVVHETINVGTETAAALKAQTEQMSRIVNELDSIHFSIKKATKLVKEIGRQVATDRCIMGLLVLVVIGVIAIIIVKLVHPNNKDIRDIPGLAPPAMTRKLLWNPN

SEQ ID NO: 14565 - protein, 220 aa, Papaver somniferum
MDLSSISDELAEIDGQISDIFRALSNGFQKLEKIKDSSRQSRQLEELTGKMRECKRLIKEFDREVKDGEHSYGPDENKLLTEKKQSMIKELNSYVALKKQYASTLDNKRVDLFDGPGGGEEYGEENVLLASNMSNQQLIDSGHRMMDDTDQAIERSKKVVEDTVNVGAETAAALKAQTEQMSRIVNELDSIHFSIKKASQLVKEIGRQVATDNVLWPSFF

SEQ ID NO: 14566 - protein, 262 aa, Gossypium raimondii
MDPLAAVSEELAEIDGQVADIFRALSNGFQKLEKIKDVNRQSRQLEELTDKMRECKRLIKEFDREVKETERRTDANTHKMLNEKKQSMVKELNSYVALKKQHQSNLENNKRVDLFDGPSEGFGEENVLLASSMTNQQLIDRGNHMMNETDQAIDRAKKVVQDTVDVGTETAAALKAQTEQMSRIVNELDSIHFSIKKASKLVKEIGRQVATDKCIMALLFLIVIGVIAIIIVKLVNPNNKDIRDIPGLAPPAMNRRLLWTPN

SEQ ID NO: 14567 - protein, 210 aa, Ambrosia trifida
MRECKRLIKEFDREVKELEHTVDPATSKILNEKKQSMVKELNSYVALKKQYATNIQNKRVDLFGGPAEGFEEDNGLLASSMTNQQLMDNGHQMMDETDQVIERSNKVVHETINVGTETAAALKAQTEQMSRIVNELDSIHFSIKKASQLVKEIGRQVATDRCIMALLFLIVVGVIAIIIVKLVHPDNKDIRDIPGLGPPAAKRRLLWTPQ

SEQ ID NO: 14568 - protein, 262 aa, Gossypium hirsutum
MDPLAAVSEELAEIDGQVADIFRALSNGFQKLEKIKDVNRQSRQLEELTDKMRECKRLIKEFDREVKETERRTDANTHKMLNEKKQSMVKELNSYVALKKQHQSNLENNKRVDIFDGPSEGFGEENVLLASSMTNQQLIDRGNHMMNETDQAIDRAKKVVQDTVDVGTETAAALKAQTEQMSRIVNELDSIHFSIKKASKLVKEIGRQVATDKCIMALLFLIVIGVIAIIIVKLVNPNNKDIRDIPGLAPPAMNRRLLWTPN

SEQ ID NO: 14569 - protein, 265 aa, Theobroma cacao
MDPLAAVSEELAEIDGQIADIFRALSNGFQKLEKVKDVNRQSRQLEELTDKMRECKRLIKEFDREVKEMESRIDPNTNRMLNEKKQSMIKELNSYVALKKQHQSNLENNKRVDLFDGPNEGFGEENVLLASSMTNQQLMDRGNQMMDETDQAIDRAKKVVQDTVDVGTETAAALKAQTEQMGRIVNELDSIHFSIKKASKLVKEIGRQVATDKCIMALLFLIVAGVIAIIIVKLVNPNNKDIRDIPGLAPPAMNRRLLWTPNRRL

SEQ ID NO: 14570 - protein, 265 aa, Eucalyptus grandis
MDDLSAISEELAELDGQISDILRALANGFQKLDKIKDANRQSRQLEELTDKMRECKRLIKEFDREIKDLEGRNDAETSRMLNEKKQSMIKELNSFVALKKRYTTNLENKRVDLFDGPSEGIGEDNGLLASSMTNQQLMDHGNQMMDETDQAIERSKKTVQDTVNVGTDTAAALKAQTEQMSRIVNELDSIHFSIKKASQLVKEIGRQVATDKCIMAFLVLIVIGVIAIIIVKIVHPNNKDIRDIPGLAPPAPTRKLLWDRKEDRW

SEQ ID NO: 14571 - protein, 337 aa, Solanum phureja
MEKVKSMEKKKLINELTQGKEFVNQLKNQIIGPLASPEECDLLIGKILSTLEKSLSILNLKALLLEGGINNTNNSSSSCSSISFLASNNNISPKSEVFDSSRDQLDKNMVSKKRKKTQQWINQTSISVNGLEGPCEDGFSWRKYGQKDILGANHPRAYYRCTHRNTQGCLATKQVQKSDGNSTIFEVTYKGRHSCKVAQSEIFSLNNQKRQKCNKKQKEEMVIFNSASPNHNVENLNIITAKEEEVFTPFPFPPAPLHIENVEENKFFPDSSELPLYLSLLTSQNDEFGMEHMILQSSDSDLTELISTPTSISNSSFGGEGMDYEHEITFDIEEFFI

SEQ ID NO: 14572 - protein, 285 aa, Solanum tuberosum
MGSGHIFFDPSSCHGNMLFLGNGDPVFRGPRSTMMKMEDSSKRRPFFSSPEDLYDEEYYDEQSPEKKRRLTPEQVHLLEKSFETENKLEPERKTQLAKKLGLQPRQVAVWFQNRRARWKTKQLERDYDQLKSSYDSLLSDFDSIRKDNDKLKSEVVSLMEKLQGKVVGGAGVSEKSDVLEVDAMTATLQVKVKAEDRLSSGSGGSAVVDEHSPQLVDSGDSYFHTDHEEYPGPGGCNVPPPMDGLQSEEDDGSDDGSCHGYFSNVFVTEEQHHEEGEEPIGWFWS

SEQ ID NO: 14573 - protein, 285 aa, Solanum phureja
MGSGHIFFDPSSCHGNMLFLGNGDPVFRGPRSTMMKMEDSSKRRPFFSSPEDLYDEDYYDEQSPEKKRRLTPEQVHLLEKSFETENKLEPERKTQLAKKLGLQPRQVAVWFQNRRARWKTKQLERDYDQLKSSYDSLLSDFDSIRKDNDKLKSEVVSLMEKLQGKVVGGAGVSEKSDVLEVDAMTATLQVKVKAEDRLSSGSGGSAVVDEHSPQLVDSGDSYFHTDHEEYPGPGGCNVPPHMDGLQSEEDDGSDDGSCHGYFSNVFVTEVQHHEEGEEPIGWFWS

SEQ ID NO: 14574 - protein, 90 aa, Nicotiana benthamiana
MGSGHIFFDPSCHGNMLFLGNSDPVFRGPRSMMKMEDSSKRRPFFSSPEELYDEEYYDEQSPEKKRRLTPEQVHLLEKSFETENKLGARA

SEQ ID NO: 14575 - protein, 287 aa, Capsicum annuum
MGSGHIFFDPSSCHGNMLFLGNGDPLFRGPRSSMLKMEDSSKRRPFFSSPEELYDEEYYDEQSPEKKRRLSPEQVHLLEKSFEAENKLEPERKTQLAQKLGLQPRQVAVWFQNRRARWKTKQLERDYDQLKSSYDSLLSDFDSIRKDNDQLKSEIVSLMEKLQGKVVGGSVVNEKSEALEVDALTTLQVKVKTEDRLSSGSGGSAVVDEHSPQLVDSGDSYFHSTIDHEEYPGPGGCNIPPPVDGLQSEEDDGSDDGSCHGYFSNAFVASEEHHHEEGEEPLGWFWS

SEQ ID NO: 14576 - protein, 285 aa, Nicotiana tabacum
  misc_feature (81)..(82): Xaa can be any naturally occurring amino acid
MGSGHIFFEPSCHGNMLFLGNSDPVFRGPRSMMKMEDSSKRRPFFSSPEELYDEEYYDEQSPEKKRRLTPEQVHLLEKSFXXENKLEPERKTQLAKKLGLQPRQVAVWFQNRRARWKTKTLERDYDQLKSSYDSLLSDFDSIRKDNEKLKAEVVSLMEKLQGKVVGEAGVINEKCEVLEVDALTLQVKVKAEDRLSSGSGGSAVVDEHSPQLVDSGDSYFHTGHMEEYPLGAGGCNNIPPPMDGLQSEEDDGSDDGGGHGYFCNVFVAAEEQQHEEGEPIGWFWS

SEQ ID NO: 14577 - protein, 284 aa, Nicotiana benthamiana
MGSGHIFFDPSCHGNMLFLGNSDPVFRGSSMMKMENSSKKRPFFSSPEELYDEEYYDEQSPEKKRRLTPEQVHLLEKSFETENKLEPERKTQLAKKLGLQPRQVAVWFQNRRARWKTKTLERDYDQLKSSYDSLLSDFDSMRKDNEKLKAEVVSLMEKLQGKVVGEGGVTSEKCEVLEVDAMTLQVKVKAEDRLSSGSGGSAVVDEHSPQLVDSGDSYFHTGHIEEYPIGAGGCNNIPPPMDGLQSEEDDGSDDGGGRGYFSNVFVAAEEQQHEEGEPIGWFWS

SEQ ID NO: 14578 - protein, 283 aa, Petunia hybrida
MESGRIFFDPSCNGNMLFLGHGDSIFRGARSMMKMEDSSKRRPFFTSPEDLYDEEYYDEQSPEKKRRLTPEQVHLLEKSFETENKLEPDRKSQLAKKLGLQPRQVAVWFQNRRARWKTKQLERDYDHLKSSYDSLLSDFDSITKDNDKLKAEVASLLEKLQGKVVGSGAGTSEKSEGLEVDAAMTLQVKAEDRLSSGSGGSAVVDEHSPQLVDSGDSYIHTGHEEYAGVGGYNIPPPVDGLNSEEDDGSDDGSCHGYFSNVFVAAEEHHHHEEEGEPLGWFWS

SEQ ID NO: 14579 - protein, 536 aa, Solanum phureja
MDSAAMTSVCGKSALCSTPGLFLGRTSGIRSSQCSFIAGNRINFPRQTAQAHRVRTNSRKGHGALTVTCRAEKILVANRGEIAVRVIRTAHEMGIPCVAVYSTIDKDALHVKLADESVCIGEAPSNQSYLVIPNVLSAAISRGCTMLHPGYGFLSENASFVEMCREHGINFIGPNPDSIRVMGDKATARDTMKNAGVPTVPGSDGLLQSTEEGVRLAEEIGYPVMIKATAGGGGRGMRLAKEPSEFVKLLQQAKSEAAAAFGNDGVYLEKYIVNPRHIEFQVLADKYGNVVHFGERDCSIQRRNQKLLEEAPSPALTSDLRKAMGDAAVAAAASIGYIGVGTIEFLLDERGSFYFMEMNTRIQVEHPVTEMISSVDLIEEQIRVAMGEKLRYKQEDIVLRGHSIECRINAEDAFKNFRPGPGRITSYLPAGGPFTRMDSHVYPDYVVPPSYDSLLGKLIVWAPTRERAIERMKRALNDTIITGVPTTIEYHKLILDIEDFKNGNVDTAFIPKHEEELAPPQQIVPAATKELINANA

SEQ ID NO: 14580 - protein, 536 aa, Capsicum annuum
MDSAAMTSVCGKSALCSTPGLFLGRTTGIRSSQCSFMAGNRINFPRQRAQAYRVSTKSSKRGGALTTTCRAEKILVANRGEIAVRVIRTAHEMGIPCVAVYSTIDKDALHVKLADESVCIGEAPSNQSYLVIPNVLSAAISRGCTMLHPGYGFLSENAVFVEMCREHGINFIGPNPDSIRVMGDKSTARDTMKNAGVPTVPGSDGLLQSTEEGVRLAEEIGYPVMIKATAGGGGRGMRLAKEPGEFVKLLQQAKSEAAAAFGNDGVYLEKYIINPRHIEFQVLADKYGNVVHFGERDCSIQRRNQKLLEEAPSPALTPELRKAMGDAAVAAAASIGYVGVGTIEFLLDERGSFYFMEMNTRIQVEHPVTEMISSVDLIEEQIRVAMGEKLQYKQEDIVLRGHSIECRINAEDAFKNFRPGPGRITSYLPAGGPFTRMDSHVYPDYVVPPSYDSLLGKLIVWGPTREKAIERMKRALSDTIITGVPTTIEYHKLILDIEDFKNGKVDTAFIPKHEDELAPPQQIVPAATKELINANA

SEQ ID NO: 14581 - protein, 536 aa, Nicotiana tabacum
MDSAALTSVCGKSALRFTPGLFLGRTNGIRSSQCSFMAGNRINFPRQRAQAYRVSTKSSTRGGALAATCRAEKILVANRGEIAVRVIRTAHEMGIPCVAVYSTIDKDALHVKLADESVCIGEAPSNQSYLVIPNVLSAAISRGCTMLHPGYGFLAENAVFVEMCREHGINFIGPNPDSIRVMGDKSTARDTMKNAGVPTVPGSDGLLQSTEEGVRLAEEIGYPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRNAMGDAAVAAAASIGYIGVGTVEFLLDERGSFYFMEMNTRIQVEHPVTEMISSVDLIEEQIRVAMGEKLRYKQEDIVLRGHSIECRINAEDAFKNFRPGPGRITAYLPAGGPFVRMDSHVYPDYVVPPSYDSLLGKLIVWAPTRERAIERMKRALNDTIITGVPTTIEYHKLILDIEDFKNGKFDTAFIPKHEEELAPPQQMVPAATKEMVNASA

SEQ ID NO: 14582 - protein, 536 aa, Amsonia hubrichtii
MDAAAMTSVCSKSLYSTPGLFMGTTRGIKSSQCSFMVGNKVQFPRQQAKASRVSRKSGNRGGALAATCRDEKILIANRGEIAVRVIRTAHEMGIPCVAVYSTIDKDALHVKLADESVCIGEAPSSQSYLVIPNVLSAAVSRGCTMLHPGYGFLAENAVFVEMCREHGINFIGPNPDSIRVMGDKSTARDTMKNAGVPTVPGSDGLLQSTEEGVRLAEEIGYPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKNFRPGPGRITAYLPAGGPFVRMDSHVYPDYVVPPSYDSLLGKLIVWAPTRERAIERMKRALNDTIITGVPTTIDYHKLILDVEDFKNGKVDTAFIPKHEKELAAPQPIVPATTEKELAKAAA

SEQ ID NO: 14583 - protein, 535 aa, Sesamum indicum
MDSATMNFCSKSVCSPPGLFMGRTTGIRSSQCSFMAGSRVNFPRQRVQASRVGHKSGKRGGALAATCRDDKILVANRGEIAVRVIRTAHEMGIPCVAVYSTIDKDALHVKLADESVCIGEAPSNQSYLVIPNVLSAAISRGCTMLHPGYGFLSENAVFVEMCREHGINFIGPNPESIRIMGDKSTARDTMKNAGVPTVPGSDGLLKSTEEAVRLADEIGYPVMIKATAGGGGRGMRLAKEPDEFVKLLQQAKTEAAAAFGNDGVYLEKFIQNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSVDLIEEQIRVARGEKLRYTQEDIVLRGHSIECRINAEDAFKNFRPGPGRITAYLPAGGPFVRMDSHVYPDYVVPPSYDSLLGKLIVWGPTRERAIERMKRALNDTIITGVPTTIDYHKLILDIEDFKNGKVDTAFIPKHEEELAAPQPTQPATTQKQLISTSA

SEQ ID NO: 14584 - protein, 239 aa, Vinca minor
MDAATMTSACSKPLCSTPGLFMGSTRGIRSSQCSFIAGSKVQFPRQHAKASRVGTKSGKRGGALAATCRSEKILIANRGEIAVRVIRTAHEMGIPCIAVYSTIDKDALHVKLADESVCIGEAPSNQSYLVIPNVLSAAVSRGCTMLHPGYGFLAENAVFVEMCREHGINFIGPNPGSIRVMGDKSTARDTMKNAGVPTVPGSDGLLQSTEEAVRLAEGIGYPVMIKATAGGSGTSDAPC

SEQ ID NO: 14585 - protein, 533 aa, Theobroma cacao
MDASMTMCKSVNSPPGLFLGRSRGIRSSQCSFMVGSRINFPRQKAQATQVRCKSNKLGGALGATCRAEKILVANRGEIAVRVIRTAHEMGIPCVAVYSTIDKDALHVKLADESVCIGEAPSSQSYLLIPNVLSAAISRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSADLIEEQIRVAMGEKLHYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMVLATPTKELTSATA

SEQ ID NO: 14586 - protein, 535 aa, Mimulus guttatus
MDSATMTFRSNSIRSTPGLFMGRTSGIRSSQCSFIAGNRVNFPRQRVQASRVGRKSGKHGGALTVTCRDDKILVANRGEIAVRVIRTAHEMGIPCVAVYSTIDKDALHVKLADESVCIGEAPSSQSYLVIPNVLSAAISRGCTMLHPGYGFLSENAVFVEMCREHGINFIGPNPDSIRVMGDKSTARDTMKNAGVPTVPGSDGLLQSNEEGIRLANEIGYPVMIKATAGGGGRGMRLAKEPDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVARGEKLRYAQEDIVLSGHSIECRINAEDAFKNFRPGPGRITAYLPAGGPFVRMDSHVYPDYVVPPSYDSLLGKLIVWAPTRERAIQRMKRALNETTITGVPTTIEYHKLILEIEDFKNGKVDTAFIPKHEQELAAPLPSQPLTSQIELVNASS

SEQ ID NO: 14587 - protein, 536 aa, Tabernaemontana elegans
MDAAAMTSVCSKSLCSTPGLFMRTTRGIRSSQCSFMVGKKVQYPQQHAKASRVSHKSGKRGGALAATCRDEKILIANRGEIAVRVIRTAHEMGIPCVAVYSTIDKDALHVKLADESVCIGEAPSSQSYLVIPNVLSAAVSRRCTMLHPGYGFLAENAVFVEMCREHGINFIGPNPDSIRVMGDKSTARETMKNAGVPTVPGSDGLLQSTEEAKKLAEEIGYPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQDDIVLQGHSIECRINAEDAFKNFRPGPGRVTAYLPAGGPFVRMDSHVYPDYVVPPSYDSLLGKLIVWAPTRERAIERMKRALNDTIITGVPTTIDYHKLILDIEDFKNGKVDTAFIPKHEKELAAPQPIVPVTTDKELTKAAA

SEQ ID NO: 14588 - protein, 538 aa, Vinca minor
MDAATMTTACSKSLCSTPPGLFVGSTRGIRSSQCSFMAGAKVQFPRQQAKASRVSPKSGKRGGALAATCRSEKILIANRGEIAVRVIRTAHEMGIPCVAVYSTIDKDALHVKLADESVCIGEAPSNQSYLVIPNVLSAAVSRGCTMLHPGYGFLAENAVFVEMCREHGINFIGPNPDSIRVMGDKSTARDTMKNAGVPTVPGSAGLLQSTEEAVKLAEEIGYPVMIKATAGGGGRGMRLANEPGEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKNFRPGPGRITAYLPAGGPFVRMDSHVYPDYVVPPSYDSLLGKLIVWAPTRERAIQRMKRALDDTIITGVPTTIDYHKLILEVEDFKNGKVDTAFIPKHEKELAAPQAIVPVTKERDLTEVAAA

SEQ ID NO: 14589 - protein, 533 aa, Gossypium raimondii
MDASLTMCKSVTSPPGLFLGRSRVIRSSQCTFMVGSRINFPRQKAQSTQVKCKSSRCGGALGAKCRAEKILVANRGEIAVRVIRTAHEMGIPCVAVYSTIDKDALHVKLADESVCIGEAPSSQSYLLIPNVLSAAISRNCTMLHPGYGFLSENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMVVASPAKELTSATA

SEQ ID NO: 14590 - protein, 533 aa, Gossypium hirsutum
MDASLTMCKSVTSPPGLFLGRSRVIRSSQCTFMVGSRINFPRQKAQSTQVRCKSSRCGGALGAKCRAEKILVANRGEIAVRVIRTAHEMGIPCVAVYSTIDKDALHVKLADESVCIGEAPSSQSYLLIPNVLSAAISRNCTMLHPGYGFLSENAVFVEMCRDHRINFIGPNPDSIRVMGDKSTARETMKNAGVPTVPGSDGLLQSTEEAIKLAHEIGFPVMIKATAGGGGRGMRLSKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMVVASPAKELTSATA

SEQ ID NO: 14591 - protein, 534 aa, Olea europaea
MDSAAMTFCNKSISSTPGLFMGRTIQIQSSQCSFVVGSKVNYPRQRVQASRVGRSSKRGGSLAATCANDKILVANRGEIAVRVIRTAHEMGIPCVAVYSTIDKDALHVKLADESVCIGEAPSSQSYLLIPNVLSAAISRGCTMLHPGYGFLAENAVFVEMCREHGINFIGPNPDSIRVMGDKSTARDTMKNAGVPTVPGSDGLLQSTEEAVRLAEEIGFPVMIKATAGGGGRGMRLAKVPNEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIERMKRALDDTIITGVPTTIDYHKLILEVEDFKNGNVDTAFIPKHEEELAPPQQDELASAKKELAKAST

SEQ ID NO: 14592 - protein, 500 aa, Nicotiana benthamiana
MAGNRINFPRQRAQAYRVSTKSSKCGGALAATCRAEKILVANRGEIAVRVIRTAHEMGIPCVAVYSTIDKDALHVKLADESVCIGEAPSNQSYLVIPNVLSAAISRGCTMLHPGYGFLSENAVFVEMCREHGINFIGPNPDSIRVMGDKSTARDTMKNAGVPTVPGSDGLLQSTEEGVRLAEEIGYPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRNAMGDAAVAAAASIGYIGVGTMEFLLDERGSFYFMEMNTRIQVEHPVTEMISSVDLIEEQIRVAMGEKLRYKQEDIVLRGHSIECRINAEDAFKNFRPGPGRITAYLPAGGPFVRMDSHVYPDYVVPPSYDSLLGKLIVWAPTRERAIERMKRALNDTIITGVPTTIEYHKLILDIEDFKNGKVDTAFIPKHEEELAPPQQIVPAATKEMVNASA

SEQ ID NO: 14593 - protein, 528 aa, Populus trichocarpa
MEATLPVCKSVTSTPGLFMGKTSGIRSSQCSFMMGNKVNFPRQRAQTAHVHCAKNGGALGVTCRAEKILVANRGEIAVRVIRTAHEMGIPCVAVYSTIDKDALHVKLADESVCIGEAPSSQSYLVIPNVLSAAISRRCTMLHPGYGFLAENAVFVEMCREHGINFIGPNPDSIRVMGDKSTARETMKKAGVPTVPGSDGLLQSTEEGVRLANEIGYPVMIKATAGGGGRGMRLAKEPDEFVKLLQQAKSEAAAAFGNDGVYLEKYVQNPRHIEFQVLADKFGNVVHFGERDCSIQRRNQKLLEEAPSPALTPELRKAMGDAAVSAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILEIEDFKNGNVDTAFIPKHEKELAAPQQIIPAKQLTNSAA

SEQ ID NO: 14594 - protein, 533 aa, Gossypium raimondii
MDASLTMCKSVTSPPGLFLGRSRVIRSSQCTFMVGSRINFPRQKAQSTQVKCKSSRCGGALGAKCRAEKILVANRGEIAVRVIRTAHEMGIPCVAVYSTIDKDALHVKLADESVCIGEAPSSQSYLLIPNVLSAAISRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMLVASPTKELTSATA

SEQ ID NO: 14595 - protein, 535 aa, Panax ginseng
MDSAAMTFCTKSVYSPPSLFTGSACGIKSSQCSFMIGSKVTFPRQKVQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITSYLPSGGPFVRMDSHVYPDYVVPPSYDSLLGKLIVWAPTRERAIARMKRALDDTIITGVPTTIEYHKLILEVEDFKNGKVDTAFIPKHEHELAAPQKIVPATPAKELANTAA

SEQ ID NO: 14596 - protein, 535 aa, Panax ginseng
MDSAAMTFCTKSVYSPPSLFTGSACGIKSSQCSFMIGSKVTFPRQKAQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIARMKRALDDTIITGVPTTIEYHKLILEVEDFKNGKVDTAFIPKHEHELAAPQKIVPATPAKELANTAA

SEQ ID NO: 14597 - protein, 533 aa, Gossypium hirsutum
MDASLTMCKSVTSPPGLFLGRSRVIRSSQCTFMVGSRINFPRQKAQSTQVKCKSSRCGVALGAKCRAEKILVANRGEIAVRVIRTAHEMGIPCVAVYSTIDKDALHVKLADESVCIGEAPSSQSYLLIPNVLSAAISRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMLVASPTKELTSATA

SEQ ID NO: 14598 - protein, 535 aa, Helianthus annuus
MDSAAVTFCSKPITSPPGVFIGRSSGIKSSQCNFLVGNKLNFPKQRFQASQKAHRSAKREGALGVTCRAEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARDTMKNAGVPTVPGSDGLLQSTEEGIRLADEIGFPVMIKATAGGGGRGMRLAKERDEFVKLLQQAKSEAAAAFGNDGVYLEKCILNPRHIEFQVLADKYGNVVHFGERDCSIQRRNQKLLEEAPSPALTPELRKAMGDAAVAAAASIGYIGVGTIEFLLDERGDFYFMEMNTRIQVEHPVTEMISSVDLIEEQIRVAMGEKLRYTQDDIVLRGHSIECRINAEDAFKNFRPGPGRITSYLPSGGPFVRMDSHVYTDYVVPPSYDSLLGKLIVWAPTREKAIERMKRALDDTIITGVPTTIEYHKLILDIEDFKNGKVDTAFIPKHEDELAEPQKPSTSNAAKEVAKAVA

SEQ ID NO: 14599 - protein, 537 aa, Gossypium raimondii
MALDSSMTMCKSVTSTPGLFLRRNTSSRSFQCTFKVGSRINFPRQKAQVTQVRCKSSKRGGALGATCRAEKILVANRGEIAVRVIRTAHEMGIPCVAVYSTIDKDALHVKLADESVCIGEAPSSQSYLLIPNVLSAALSRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLHYKQEDIVLRGHSIECRINAEDAFKGFRPGPGRITSYLPSGGPFVRMDSHVYPDYVVPPSYDSLLGKLIVWAPTREKAIERMKRALDDTVITGVPTTIEYHKLILDIEDFRNGKVDTAFIPKHEEELAAPQKMVLATAAKELTSASATA

SEQ ID NO: 14600 - protein, 535 aa, Panax ginseng
MDSAAMTFCTKSVYYPPSLFAGSACGIKSSQCSFMIGSKVKFPRQKAQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIARMKRALDDTIITGVPTTIEYHKLILEVEDFKNGKVDTAFIPKHEHELAAPQKIVPATPAKELANTAA

SEQ ID NO: 14601 - protein, 533 aa, Manihot esculenta
MEATLPVCKSVVTSTTPGLFMGRTGGIGSSQCSFMVGSRINFPRQRVRAAQVSRKAKKNGAGALGATCRADKILIANRGEIAVRVIRTAHEMGIPCVAVYSTIDKDALHVKLADESVCIGEAPSSQSYLLIPNVLSAAISRGCTMLHPGYGFLAENAVFVEMCREHGINFIGPNPDSIRVMGDKSTARETMKNAGVPTVPGSQGLLQSTEEAVKLANEIGYPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTAELRKAMGDAAVAAAASIGYIGVGTVEFLLDERGSFYFMEMNTRIQVEHPVTEMISSVDLIEEQIRVAMGEKLRYTQENIVLRGHSIECRINAEDAFKGFRPGPGRITAYLPSGGPFVRMDSHVYPDYVVPPSYDSLLGKLIVWAPTREKAIERMKRALEDTIITGVPTTIDYHKLILDIEDFRNGKVDTAFIPKHEQELAAPQNIVPVKELANATA

SEQ ID NO: 14602 - protein, 533 aa, Gossypium hirsutum
MDASLTMCKSVTSPPGLFLGRSRVIRSSQCTFMVGSRINFPRQKAQSTQVKCKSSRCGVALGAKCRAEKILVANRGEIAVRVIRTAHEMGIPCVAVYSTIDKDALHVKLADESVCIGEAPSSQSYLLIPNVLSAAISRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGIVDTAFIPKHEEELAAPQKMLVASPTKELTSATA

SEQ ID NO: 14603 - protein, 533 aa, Prunus persica
MDATMPICKIVTPTPGLFFGRTREIQSSQCSFMVGNKVNFLRQRARGAQVTFKSRKHGGALHATCRAEKILVANRGEIAVRIIRTAHEMGIPCVAVYSTIDKDALHVKLADESVCIGEAASSQSYLVVPNVLSAAISRKCTMLHPGYGFLAENASFVEMCREHGINFIGPKPDSIRVMGDKATARDTMKTAGVPTVPGSDGLLQSTEEGIRLADEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKGFRPGPGRITAYLPSGGPFVRMDSHVYPDYVVPPNYDSLLGKLIVWAPTREKAIERMKRALDDTIITGVPTTIEYHKLILDIEDFKNGKVDTAFIPKHEEELAAPQHLVPAAPAKELAGASA

SEQ ID NO: 14604 - protein, 537 aa, Gossypium hirsutum
MALDSSMTMCKSVTSTPGLFLRRNTSSRSFQCTFKVGTRINFPRQKAQVTQVRCKSSKRGGALGATCRAEKILVANRGEIAVRVIRTAHEMGIPCVAVYSTIDKDALHVKLADESVCIGEAPSSQSYLLIPNVLSAALSLNCTMLHPGYGFLAENAVFVEMCRDHRINFIGPDPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITSYLPSGGPFVRMDSHVYPDYVVPPSYDSLLGKLIVWAPTREKAIERMKRALDDTVITGVPTTIEYHKLILDIEDFRNGKVDTAFIPKHEEELAAPQKMVLATAAKELTSASATA

SEQ ID NO: 14605 - protein, 535 aa, Echinacea purpurea
MDSAAVTFCSKPITSPPGLFIGRSSGIKSSQCNFLAGNKLSFPKQRFQASQKAHRSAKRDGALGVTCRQEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARDTMKNAGVPTVPGSDGLLQSTEEGIRLADEIGFPVMIKATAGGGGRGMRLAKEREEFVKLLQQAKSEAAAAFGNDGVYLEKCILNPRHIEFQVLADKYGNVVHFGERDCSIQRRNQKLLEEAPSPALTPELRKAMGDAAVAAAASIGYIGVGTIEFLLDERGDFYFMEMNTRIQVEHPVTEMISSVDLIEEQIRVAMGEKLRYTQDDIVLRGHSIECRINAEDAFKNFRPGPGRITSYLPSGGPFVRMDSHVYTDYVVPPSYDSLLGKLIVWAPTREKAIERMKRALDDTIITGVPTTIEYHKLILDVEDFKNGKVDTAFIPKHEDELAEPHKSSTTNAAKEIAKAVA

SEQ ID NO: 14606 - protein, 535 aa, Panax ginseng
MDSAAMTFCTKSVYYPPSLFAGSACGIKSSQCSFMIGSKVKFPRQKAQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIARMKRALDDTIITGVPTTIEYHKLILEVEDFKNGKVDTAFIPKHEHELEAPQKIVPATPAKELANTAA

SEQ ID NO: 14607 - protein, 537 aa, Gossypium hirsutum
MALDSSMTMCKSVTSPPGLFLRRNTSSRSFQCTFKVGSRINFPRQKAQVTQVRCKSSKRGGALGATCRAEKILVANRGEIAVRVIRTAHEMGIPCVAVYSTIDKDALHVKLADESVCIGEAPSSQSYLLIPNVLSAALSRNCTMLHPGYGFLAENAVFVEMCRDHRINFIGPNPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISFVDLIEEQIRVAMGEKLHYKQEDIVLRGHSIECRINAEDAFKGFRPGPGRITSYLPSGGPFVRMDSHVYPDYVVPPSYDSLLGKLIVWAPTREKAIERMKRALDDTVITGVPTTIEYHKLILDIEDFRNGKVDTAFIPKHEEELAAPQKMVLATAAKELTSASATA

SEQ ID NO: 14608 - protein, 357 aa, Ambrosia trifida
MDSAAMTFCSKPITSPPGLFIGRSSGIKSSQCNFLVGNKLSFPTQRVQASQKAHRSGKREGALGVTCRAEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARDTMKNAGVPTVPGSDGLLQSTEEGIRLADEIGFPVMIKATAGGGGRGMRLAKERDEFVKLLQQAQSEAAAAFGNDGVYLEKCIINPRHIEFQVLADKYGNVVHFGERDCSIQRRNQKLLEEAPSPALTPELRKAMGDAAVAAAASIGYIGVGTIEFFWMKEVILFYGNEH

SEQ ID NO: 14609 - protein, 535 aa, Flaveria ramosissima
MDSAAVTFCSKPITSPPGLFVGRSSGIKSSQCNFLVGNKLSFPKQRFQASQKAHRSVKREGALGVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKSTARDTMKNAGVPTVPGSDGLLQSTEEGIRLADEIGFPVMIKATAGGGGRGMRLAKERDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGEFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALDDTIITGVPTTIEYHKLILDVEDFKNGKVDTAFIPKHEDELAEPQKLSTSNAAKEVAKAVA

SEQ ID NO: 14610 - protein, 532 aa, Prunus mume
MDATMPICKIVTPTPGLFFGRTREIQSSQCSFMVGNKVNFLRQRAWGAQVTFKSRKHGGALHATCAEKILVANRGEIAVRIIRTAHEMGIPCVAVYSTIDKDALHVKLADESVCIGEAASSQSYLVVPNVLSAAISRKCTMLHPGYGFLAENASFVEMCREHGINFIGPKPDSIRVMGDKATARDTMKTAGVPTVPGSDGLLQSTEEGIRLADEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKGFRPGPGRITAYLPSGGPFVRMDSHVYPDYVVPPNYDSLLGKLIVWAPTREKAIERMRRALDDTIITGVPTTIEYHKLILDVEDFKNGKVDTAFIPKHEEELAAPQHLVPAAPAKELAGASA

SEQ ID NO: 14611 - protein, 189 aa, Flaveria ramosissima
MDSAAVTFCSKPITSPPGLFIGRSSGIKSSQCNFLTGNKLSFPKQRFQASQKAHRSVKREGALGVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGTNQLHETP

SEQ ID NO: 14612 - protein, 525 aa, Vitis vinifera
METTMNVCKSVISPPGLFVGTPQGIRSSQCSFMVGKKVNFPRQVAQVARVRSKSKKHGGALGATCRNDKILVANRGEIAVRVIRTAHEMGIPCVAVYSTIDRDALHVKLADESVCIGEAPSSQSYLLIPNVLSAAISHGCTMLHPGYGFLAENATFVEMCREHGINFIGPNPDSIRVMGDKSTARDTMKNAGVPTVPGSEGLLKSTEEGIKLANEIGYPVMIKATAGGGGRGMRLAKEPDEFVKLLQQAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVAMGEKLHYKQEDIVLRGHSIECRINAEDAFKNFRPGPGRITAYLPAGGPFVRMDSHVYPDYVVPPSYDSLLGKLIVWAPTRERAIERMKRALNDTVITGVPTTIDYHKLILDIEDFRNGKVDTAFIPKHEEELAAPLAIVNATVA

SEQ ID NO: 14613 - protein, 533 aa, Camellia sinensis
MDSALTFCKSVHSPPGLFVGRSRGIQSPQCSVMVGSRVNFPRQSVRVAQISRKSEKRGGALCATCRDEKILVINRGEIAVRIIRTAHEMGIPCVAVYSTIDKDALHVKLADESVCIGEAPSSQSYLVIPNVLSAAISRGCTMLHPGYGFLAENAVFVEMCREHGINFIGPNPDSIRVMVDKATARETMKNAGVPTVPGSEGLLQNTEEAVRLSEEIGFPVMIKATAGGGGRGMRLAKEPDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKNFRPGPGRITAYLPSGGPFVRMDSHVYPDYVVPPSYDSLLGKLIVWAPTRERAIERMKRALNDTIIIGVPTTIDYHKLILDVEDFKNGKVDTAFIPKHEQELAAPQKMVPATPAKELTKATA

SEQ ID NO: 14614 - protein, 532 aa, Citrullus lanatus
MDAAMPLCKSARAPSLTGLFAGTTNGLRSSQCTFMGAKKVSFPRQRATGVQYSRKSWKNGRGLQVMCRADKILVANRGEIAVRIIRTAHELGIPCVAVYSTIDKDALHVKLADESVCIGEAPSSQSYLVIPNVLSAAISRGCTMLHPGYGFLAENAVFVEMCREHGINFIGPNPDSIRVMGDKSTARDTMKKAGVPTVPGSDGLLQSTEEAIKLAQEIGYPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSVDLIEEQIRVAMGEKLRFKQEDIVLRGHSIECRINAEDAFKGFRPGPGRITAYLPSGGPFVRMDSHVYTDYVVPPSYDSLLGKLIVWAPTREKAIERMKRALDDTIITGVPTTIEYHKLILDVEDFKNGKVDTAFIPKHEQELAAPQKMVVAKDLANAVA

SEQ ID NO: 14615 - protein, 527 aa, Panax ginseng
MDSAAMTFCTKSVYYPPSLFAGSACGIKSSQCSFMIGSKVKFPRQKAQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIARMKRALDDTIITGVPTTIEYHKLILEVEDFKNGKVDTAFIPKHEHELAAPQKIVPATPA

SEQ ID NO: 14616 - protein, 541 aa, Cichorium intybus
MDSAAMTFCSKPITSPPGLFIGRSSGIKSSQCSFLVGNKVNFPRQRVQASQKARKSGKHEGALGATCRAEKILIANRGEIAVRVIRTAHEMGIPCVAVYSTIDKDALHVKLADESVCIGEAPSSQSYLLIPNVLSAAISHGCTMLHPGYGFLAENAVFVEMCRGHGINFIGPNPDSIRVMGDKATARDTMKNAGVPCVPGGEGLLQSTEEGIKLADEIGYPVMIKATAGGGGRGMRLAKERDEFVKLLQQAQSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQEDIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILEIEDFKNGIVDTAFIPKHEEELAEPQPQPQPRKLITSTSTKEVSNAVA

SEQ ID NO: 14617 - protein, 534 aa, Flaveria ramosissima
MDSAAVTFCSKPITSTPGLFVGRTSGIKSSQCNFLVGSKLSFPKQRFQASQKAHRSVTREGALGVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKSTARDTMKNAGVPTVPGSDGLLQSTEEGIRLADEIGFPVMIKATAGGGGRGMRLAKERDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGEFYFMEMNTRIQVEHPVTEMISSVDLIEEQIRVAMGEKLRYTQDEIVLRGHSIECRINAEDAFKNFRPGPGKITSYLPSGGPFVRMDSHVYTDYVVPPSYDSLLGKLIVWAPTREKAIERMKRALDDTIITGVPTTIEYHKLILDIEDFKNGKVDTAFIPKHEDELAEPQKLSTSNAKEVAKTVA

SEQ ID NO: 14618 - protein, 536 aa, Quercus alba
MDATLPFCKSVTSTPGLFVGTSRGIRAASQCSFMVGNSRVNFPRQRAECAQVGSYKAKKRGGALHATCRAEKILIANRGEIAVRVIRTAHEMGIPCVAVYSTIDKDALHVKLADESVCIGEAPSNQSYLLIQNVLSAAISRKCTMLHPGYGFLAENAVFVEMCREHRINFIGPNPDSIRVMGDKSTARETMKKAGVPTVPGSDGLLQSTEEAIKLANEIGYPVMIKATAGGGGRGMRLAKEPEEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIEYHKLILEVEDFKNGKVDTAFIPKHEQELAAPQNLVPTTSGKELAGTAA

SEQ ID NO: 14619 - protein, 527 aa, Malus domestica
MDATMPICKTVTPTPGLFFGRTREIRSSQCSFMVGNKVNFLRQRVQGAQVSVKSRKHGGALHATCHAEKILVANRGEIAVRVIRTAHEMGIPCVAVYSTIDKDALHVKLADESVCIGEAASSQSYLVVPNVLSAAISRKCTMLHPGYGFLSENASFVEMCKEHGINFIGPKPESIRVMGDKSTARDTMKKAGVPTVPGSDGLLQSTEEGIRLADEIGFPVMIKATAGGGGRGMRLAKEPEEFVKLLQQAKSEAAAAFGNDGVYLEKYIQNPRHIEFQVLADKYGNVIHFGERDCSIQRRNQKLLEEAPSPALTPELRKAMGDAAVAAAASIGYIGVGTVEFLLDERGSFYFMEMNTRIQVEHPVTEMISSVDLIEEQIHVAMGEKLRYTQEDIVLRGHSIECRINAEDAFKGFRPGPGRITAYLPSGGPFVRMDSHVYPDYVVPPNYDSLLGKLIVWAPTREKAIERMKRALDDTVITGVPTTIEYHKLILDIEDFKNGKVDTAFIPKHEEELQAPQHLVPAAAAKN

SEQ ID NO: 14620 - protein, 532 aa, Euonymus alatus
MEVSMTMTTCKSVTSPPGLFIGRARGIKSSQSSFLVGSNVNFPRLRAQAAQVTCKSKKNGGALRTVCRADKILVANRGEIAVRIIRTAHEMGIPCVAVYSTIDKDALHVKLADESVCIGEAPSSQSYLVIPNVLSAAVSRRCTMLHPGYGFLAENAVFVEMCKEHGINFIGPNPDSIRVMGDKSTARDTMKNAGVPTVPGSDGLLQNTEEGIRLANEIGFPVMIKATAGGGGRGMRLAKEPDEFVKFLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMIFSVDLIEEQIRVAMGEKLRYKQEDISLRGHSIECRINAEDAFKGFRPGPGRITSYLPSGGPFVRMDSHVYPDYVVPPNYDSLLGKLIVWAPTREKAIERMKRALDDTIITGVPTTIDYHKLILDIEDFRNGKVDTAFIPKHEQELAAPQTLVPVKELSNASA

SEQ ID NO: 14621 - protein, 526 aa, Populus trichocarpa
MEATLPVCKSVTSTPGLFMKRNSGIRNSQCSFMVGTKVNFPRQRTQATQANHCAKKNGGALGVTCRAEKILVANRGEIAVRVIRTAHELGIPCVAVYSTIDKDALHVKLADESVCIGEAPSNQSYLVIQNVLSAAISRGCTMLHPGYGFLAENAVFVEMCREHGINFIGPNPDSIRVMGDKSTARETMKKANVPTVPGSDGLLQSTEEAVKLASEIGYPVMIKATAGGGGRGMRLAKEPDEFVKLLQQAKSEAAAAFGNDGVYLEKYVQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLQYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFKNGNVDTAFIPKHEQELAAPQQIILANSAS

SEQ ID NO: 14622 - protein, 535 aa, Helianthus annuus
MDSAAVTFCSKPVTSPPGLFVGRSSGIKSSQCNFLVGNKLNFPKQRVQSSQKARSSGKHEGALNVTCRAEKILVANRGEIAVRVIRTAHELGIPCVAVYSTIDKDALHVKLADEAVCIGEAPSSQSYLLIPNVLSAAISRGCTMLHPGYGFLAENAVFVEMCREHGINFIGPNPDSIRVMGDKSTARDTMKNAGVPTVPGSDGLLQSTEEGIKLADEIGFPVMIKATAGGGGRGMRLAKERDEFVKLLQQAQSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGEFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALDDTIITGVPTTIDYHKLILDIEDFKNGKVDTAFIPKHEEELAEPQKLITPNGAKDVAKAVA

SEQ ID NO: 14623 - protein, 285 aa, Panax ginseng
MDSAAMTSCTKSVYYPPSLFAGSACGIKSSQCSFMIGSKVKFSRQKAQAYKVSRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHMEFRVCRQVW

SEQ ID NO: 14624 - protein, 323 aa, Tripterygium wilfordii
MEASMTMTTCKSITSPPDLFIGRTRGIKSSQCSFLAGSNVNLPRQRAQTAQVSRKSKKNGGALSAVCRADKILVANRGEIAVRVIRTAHEMGIPCVAVYSTIDKDALHVKLADESVCIGEAPSSQSYLVIPNVLSAAVSRGCTMLHPGYGFLAENAVFVEMCKEHGINFIGPNPDSIRVMGDKSTARETMKNAGVPTVPGSDGLLQSTEEGIRLANNIGFPVMIKATAGGGGRGMRLAKEPDEFVKLLQQAKSEAAAAFGNDGVYLEKYIQNPRHIEFQVLADKYGNVVHFGERDCSIQRRNQKFAGRGTLSCIDTRVAESHG

SEQ ID NO: 14625 - protein, 393 aa, Cirsium arvense
MLHPGYGFLAENAVFVEMCREHGINFIGPNPDSIRVMGDKATARDTMKTAGVPTVPGSEGLLQSTEEGIKLADEIGFPVMIKATAGGGGRGMRLAKERDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKNGKVDTAFIPKHEEELAEPQKLIALNAAAKEVAKSVA

SEQ ID NO: 14626 - protein, 537 aa, Triphysaria pusilla
MDSATMTFCSNPCVRSPPGLFMGSTTGIRSSQCSFFMAGRVNFPQQRLQASSRVGRKSGKRGGALGATCLDDKILVANRGEIAVRVIRTAHEMGIPCVAVYSTIDKEALHVKLADESVCIGEAPSSQSYLVIPNVLSAAISRGCTMLHPGYGFLSENAVFVEMCREHGINFIGPNPNSIRVMGDKSTARDTMKNAGVPTVPGSDGLVQTTDEAVKIAEQIGYPVMIKATAGGGGRGMRLAKTPDEFVKLLQQAKSEAAAAFGNDGVYLEKYIQNPRHIEFQVLADKFGNVVHFGERDCSIQRRNQKLLEEAPSPALTAELRKAMGDAAVAAAASIGYIGVGTVEFLLDERGSFYFMEMNTRIQVEHPVTEMISSVDLIEEQICVAMGEKLRYAQEDIVLSGHSIECRINAEDAFKNFRPGPGRITAYLPAGGPFVRMDSHVYPDYVVPPSYDSLLGKLIVWAPTRERAIARMKRALNDTIITGVPTTIEYHKLILEIEDFKNGKVDTAFIPKHEQELAEPVSNELVKAHKEPVNASA

SEQ ID NO: 14627 - protein, 535 aa, Eucalyptus grandis
MEATLPMCSKSVAASTPGLVFRRADSIQSSQCSFLVGSRVNFPKQRCRAVKVGHASKRRGGALNATCRADKILVANRGEIAVRVIRTAHEMGIPCVAVYSTIDKDALHVKLADESVCIGEAPSSQSYLVIPNVLSAAISRGCTMLHPGYGFLSENAVFVEMCKEHGINFIGPNPESIRVMGDKSTARETMKNAGVPTVPGSDGLLQSTEEGVRLAQEIGYPVMIKATAGGGGRGMRLAKEPDEFVKLLQQAKSEAGAAFGNDGVYLEKCILNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWGPTREKAIERMKRALNDTIITGVPTTIDYHKLILDIEDFRNGKVDTAFIPKHEDELREPQKMVLAAPAKELTGATV

SEQ ID NO: 14628 - protein, 122 aa, Arnica chamissonis
MDSAAVTFCSKPISSPPGLFVGRSSGIKSSRCNFLVGSKVSFPKQRVQASQKAHSSGKREGALGVTCRAEKILVANRGEIAVRVIRTAHELGIPCVAVYSTIDKDALHVKLADESVCSRGSS

SEQ ID NO: 14629 - protein, 537 aa, Citrus clementina
MDASMTMSKSVTTTSPGLFVGRGKGILRSSQCSFMVGSRTVNFPRQVVAGVGGKLKRRCSGGGALKVTCRQEKILVANRGEIAVRVIRTAHEMGIPCVAVYSTIDKDALHVKLADESVCIGEAPSSQSYLLIPNVLSAAISRGCTMLHPGYGFLAENAVFVEMCREHGINFIGPNPDSIRIMGDKSTARETMKNAGVPTVPGSDGLLQSTEEAVKLADELGFPVMIKATAGGGGRGMRLAKEPGEFVKLLQQAKSEAAAAFGNDGVYLEKYVQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIYVAMGGKLRYKQEDIVLQGHSIECRINAEDPFKNFRPGPGRITAYLPAGGPFVRMDSHVYPDYVVPPSYDSLLGKLIVWAPTREKAIERMKRALNDTIITGVPTTIEYHKLILDVEDFKNGKVDTAFIPKHEQELQAPQKIVLATTPNEMAGATA

SEQ ID NO: 14630 - protein, 537 aa, Citrus sinensis
MDASMTMSKSVTTTSPGLFVGRGKGILRSSQCSFMVGSRTVNFPRQVVAGVGGKLKRRCGGGGALKVTCRQEKILVANRGEIAVRVIRTAHEMGIPCVAVYSTIDKDALHVKLADESVCIGEAPSSQSYLLIPNVLSAAISRGCTMLHPGYGFLAENAVFVEMCREHGINFIGPNPDSIRIMGDKSTARETMKNAGVPTVPGSDGLLQSTEEAVKLADELGFPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIHVAMGGKLRYKQEDIVLQGHSIECRINAEDPFKNFRPGPGRITAYLPAGGPFVRMDSHVYPDYVVPPSYDSLLGKLIVWAPTREKAIERMKRALNDTIITGVPTTIEYHKLILDVEDFKNGKVDTAFIPKHEQELQAPQKIVLATTPNEMAGATA

SEQ ID NO: 14631 - protein, 542 aa, Centaurea maculosa
MDSAALTFCSSKPISSPPGLVIGRSSGIKSSQCNFLVGSKVSFPRQRVQASQRVRRSAKREGALGVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARDTMKTAGVPTVPGSDGLLQSTEEGIKLADEIGFPVMIKATAGGGGRGMRLAKERDEFVKLLQQAQSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKNGNVDTAFIPKHEEELAEPQKLIASNNAAAAAAAKEVAKSVA

SEQ ID NO: 14632 - protein, 533 aa, Fragaria vesca
MDATMPICKTVSPTPGLFFGKTGEIRSSQCSFMVGNKVSFLRQRAQGAQISYRSRKHAGTLHATCRADKILVANRGEIAVRVIRTAHEMGIPCVAVYSTIDKDALHVKLADESVCIGEAASNQSYLVVPNVLSAAISRKCTMLHPGYGFLSENASFVEMCKEHGINFIGPKPESIRIMGDKSTARETMKQAGVPTVPGSDGLLKSTEEGMKLADEIGYPVMIKATAGGGGRGMRLAKEPEEFVKLLQAAKSEAAAAFGNDGVYLEKYVVNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRMTQDDIVLRGHSIECRINAEDAFKGFRPGPGRITAYLPAGGPFVRMDSHVYPDYVVPPNYDSLLGKLIVWAPTREKAIDRMKRALNDTIITGVPTTIEYHKLILEIEDFKNGKVDTAFIPKHEEELAAPQQVLPASPPKELASASA

SEQ ID NO: 14633 - protein, 534 aa, Eschscholzia californica
MDASTFCKSVCSPTVPGLFATQTRQIRSSQCSFMVGSGAIFPKQKAQMIHLSQKTKKRVGALSVTCRGDKILVANRGEIAVRVIRTAHEMGIPCVAVYSTIDKDALHVKLADEAVCIGEAPSNQSYLVIPNVLSAAISRGCTMLHPGYGFLAENAVFVEMCREHGINFIGPNPDSIRVMGDKSTARETMKKAGVPTVPGSDGLLQSTEEGIRLAHEIGYPVMIKATAGGGGRGMRLAKEPEEFVKLLQQAKSEAGAAFGNDGVYLEKYVQNPRHIEFQVLADMFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTRERAIERMKRALNDTIITGVPTTIEYHKLILEIEDFKNGNVDTAFIPKHEEELAEPQKMVPSPSLKELVNTSN

SEQ ID NO: 14634 - protein, 536 aa, Jatropha curcas
MEATLPICKPKSAVISTTPGLLTGRSSGIGSSQCSFMVGSKVNFPRQRIRAGRVSHKAGKSSNGGAIGVKCRADKILIANRGEIAVRIIRTAHELGIPCVAVYSTIDKDALHVKLADESVCIGEAPSSQSYLLIPNVLSAAISRGCTMFHPGYGFLAENAVFVEMCREHGINFIGPNPDSIRVMGDKSTARETMKNAGVPTVPGSDGLLQNTEEAVKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILEIEDFKNGKVDTAFIPKHEQELAAPQKIVPVKELASTTA

SEQ ID NO: 14635 - protein, 536 aa, Tragopogon dubius
MDSAAMTFCSKPITSPPGLFIGRSSGIKSSQCTFLVGNKVNFPRQRVQASQKARKSSKHEGALTVTCSGDKILVANRGEIAVRVIRTAHELGIPCVAVYSTIDKDALHVKLADEAVCIGEAPSSQSYLLIPNVLSAAISRGCTMLHPGYGFLSENAMFVEMCREHGINFIGPNPDSIRVMGDKATARETMKKAGVPTVPGSEGLLSSTEEGIKLADEIGFPVMIKATAGGGGRGMRLAKERDEFVKLLQQAQSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGAFYFMEMNTRIQVEHPVTEMISSVDLIEEQIRVAMGEKLRYTQEDIVLRGHSIECRINAEDAFKNFRPGPGRITAYLPSGGPFVRMDSHVYTDYVVPPSYDSLLGKLIVWAPTREKAIERMKRALNDTIITGVPTTIEYHKLILEIEDFKNGNVDTAFIPKHEEELAEPHELMIRSSSGREIEEAVA

SEQ ID NO: 14636 - protein, 119 aa, Valeriana officinalis
MDAAMTFCSKPVCSPTPNKKLLSGRASTISSSQCSFMVGNRVQFPRQRAQALQFSRKSVKSGRAVTITCRAEKILVANRGEIAVRVIRTAHEMGIPCVAVYSTIDKMHFTSNWLMIRFV

SEQ ID NO: 14637 - protein, 526 aa, Ambrosia trifida
SKPITSPPGLFIGRSSGIKSSQCNFLVGNKLSFPKQRVQASQKACRSGKREGALGVTCRAEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARDTMKNAGVPTVPGSDGLLQSTEEGIRLADEIGFPVMIKATAGGGGRGMRLAKERDEFVKLLQQAQSEAAAAFGNDGVYLEKCIINPRHIEFQVLADKYGNVVHFGERDCSIQRRNQKLLEEAPSPALTPELRKAMGDAAVAAAASIGYIGVGTIEFLLDERGDFYFMEMNTRIQVEHPVTEMISSVDLIEEQIRVAMGEKLRYTQDDIVLRGHSIECRINAEDAFKNFRPGPGRITSYLPSGGPFVRMDSHVYTDYVVPPSYDSLLGKLIVWAPTREKAIERMKRALDDTIITGVPTTIEYHKLILDIEDFKNGKVDTAFIPKHEDELAEPHKSSTSNAAKEVAKALA

SEQ ID NO: 14638 - protein, 542 aa, Centaurea maculosa
  misc_feature (382)..(382): Xaa can be any naturally occurring amino acid
MDSAALTFCSSKPISSPPGLVIWRSSGIKSSQCNFLVGSKVSFPRQRVQASQRVRRSGKREGALAVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARDTMKTAGVPTVPGSDGLLQSTEEGIRLADEIGFPVMIKATAGGGGRGMRLAKERDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIXVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKNGKVDTAFIPKHEEELAEPQKLIASNNAAAAAAAKEIAKSVA

SEQ ID NO: 14639 - protein, 542 aa, Cirsium arvense
MDSAALTFCSSKPISSPPGLVIGRSSGIKSSQCNFLVGSKVSFPRQRVQASQRVRRSAKREGALAVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARDTMKTAGVPTVPGSEGLLQSTEEGIKLADEIGFPVMIKATAGGGGRGMRLAKERDEFVKLLQQAQSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKNGNVDTAFIPKHEEELAEPQKLIASNNAAAAAAAKEVAKSVA

SEQ ID NO: 14640 - protein, 517 aa, Arnica chamissonis
MDSAAVTFCSKPITSPPGLFIGRSSGIKSSQCNFLVGNKLSFPKQRFQAFQRAHRSGKREGALAVTCRAEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARDTMKNAGVPTVPGSDGLLQSTEEGIRLADEIGFPVMIKATAGGGGRGMRLAKERDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGEFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKAGNVDTAFIPKHEDELAE

SEQ ID NO: 14641 - protein, 534 aa, Eutrema parvulum
MDASMITNCKSVASLPSLFLGRSGGSIRSSQCNVMGKSVSFPRQKTQTLKVSRNVKRSGGGGALAATCSSGDKILVANRGEIAVRVIRTAHEMGIPCVAVYSTIDKDALHVKLADEAVCIGEAPSNQSYLLIPNVLSAAISRGCTMLHPGYGFLAENALFVEMCRDHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYKQEEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILDVEDFKNGKVDTAFIPKHEEELAEPQEIVPVKDLTNVAA

SEQ ID NO: 14642 - protein, 538 aa, Triphysaria pusilla
MDSATMTFCSNPYVRSPTGLFMGSTAGIRSSQCSFFMAGRVNFPRQRIQASKVGRKSGQRGGALGATCHDDKILVANRGEIAVRVIRTAHEMGIPCVAVYSTIDRDALHVKLADESVCIGEAPSNQSYLVIPNVLSAAISRGCTMLHPGYGFLSENAVFVEMCREHGINFIGPNPNSIRVMGDKSTARDTMKNAGVPTVPGSDGLLQTTDEAVKIADQIGYPVMIKATAGGGGRGMRLAKTPDEFVKLLQQAKSEAAAAFGNDGVYLEKYIQNPRHIEFQVLADKFGNVVHFGERDCSIQRRNQKLLEEAPSPALTEELRKAMGDAAVAAAASIGYIGVGTVEFLLDERGSFYFMEMNTRIQVEHPVTEMISSVDLIEEQIRVARGEKLRYVQEDIVLKGHSIECRINAEDAFKNFRPGPGRITAYLPAGGPFVRMDSHVYPDYVVPPSYDSLLGKLIVWAPTRERAIQRMKRALNETTITGVPTTIEYHKLILDIEDFKNGKVDTAFIPKHEQELAAPVSNELAMVPKEPVNASSSA

SEQ ID NO: 14643 - protein, 532 aa, Triphysaria pusilla
MTFCSNPCVRSPPGLFMGSTTGIRSSQCSFFMAGRVNFPQQRLQASSRVGRKSGKRGGALGATCLDDKILVANRGEIAVRVIRTAHEMGIPCVAVYSTIDKEALHVKLADESVCIGEAPSSQSYLVIPNVLSAAISRGCTMLHPGYGFLSENAVFVEMCREHGINFIGPNPNSIRVMGDKSTARDTMKNAGVPTVPGSDGLVQTTDEAVKIAEQIGYPVMIKATAGGGGRGMRLAKTPDEFVKLLQQAKSEAAAAFGNDGVYLEKYIQNPRHIEFQVLADKFGNVVHFGERDCSIQRRNQKLLEEAPSPALTAELRKAMGDAAVAAAASIGYIGVGTVEFLLDERGSFYFMEMNTRIQVEHPVTEMISSVDLIEEQICVAMGEKLRYAQEDIVLSGHSIECRINAEDAFKNFRPGPGRITAYLPAGGPFVRMDSHVYPDYVVPPSYDSLLGKLIVWAPTRERAIARMKRALNDTIITGVPTTIEYHKLILEIEDFKNGKVDTAFIPKHEQELAEPVSNELVKAHKEPVNASA

SEQ ID NO: 14644 - protein, 557 aa, Theobroma cacao
MDASMTMCKSVNSPPGLFLGRSRGIRSSQCSFMVGSRINFPRQKAQATQVRCKSNKLGGALGATCRAEKILVANRGEIAVRVIRTAHEMGIPCVAVYSTIDKDALHVKLADESVCIGEAPSSQSYLLIPNVLSAAISRNCTMLHPGYGFLAENAVFVEMCRDHRINFIGPNDLIEIDYCKYEISVLNEFWLLLWQPDSIRVMGDKSTARETMKNAGVPTVPGSDGLLQSTEEAIKLAHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSADLIEEQIRVAMGEKLHYKQEDIVLRGHSIECRINAEDAFKGFRPGPGRITSYLPSGGPFVRMDSHVYSDYVVPPSYDSLLGKLIVWAPTREKAIERMKRALDDTVITGVPTTIEYHKLILDIEDFRNGKVDTAFIPKHEEELAAPQKMVLATPTKELTSATA

SEQ ID NO: 14645 - protein, 523 aa, Prunus persica
MDAIMPICKTVTPSPGLFFGKTREIRSSKCSFMVGNKVNFLRQRAQGAQVSFKSRKHGGALHATCRAEKILVANRGEIAVRIIRTAHEMGIPCVAVYSTIDKDALHVKLADESVCIGEAASSQSYLVVPNVLSAAISRKCTMLHPGYGFLAENASFVEMCREHGINFIGPKPDSIRVMGDKSTARDTMKKAGVPTVPGSDGLLESTEEGIRLADEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGTFYFMEMNTRIQVEHPVTEMISSVDLIEEQIRVAMGEKLRYSQDEIVLRGHSIECRINAEDAFKGFRPGPGRITAYLPSGGPFVRMDSHVYPDYVVPPNYDSLLGKLIVWAPTREKAIERMKRALDDTIITGVPTTIEYHKLILDIEDFKNGKVDTAFIPKHEEELAAPQHLVLKN

SEQ ID NO: 14646 - protein, 532 aa, Eutrema halophilum
MDAYMITNCKSFASPPSLFLGRSGGIRSSQCNAMMGKMVSFPRQRTQTLKVTRKVKRSGGGALAATCSGDKILVANRGEIAVRIIRTAHEMGIPCVAVYSTIDKDALHVKLADEAVCIGEAPSNQSYLLIPNVLSAAISRGCTMLHPGYGFLAENALFVEMCRDHRINFIGPNPDSIRVMGDKATARETMKNAGVPTVPGSDGLLQSTEEGVRLANEIGFPVMIKATAGGGGRGMRLANEPSEFVKLLQQAKSEAAAAFGNDGCYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQVRVAMGEKLRYKQEDIVLRGHSIECRINAEDPFKGFRPGPGRITSYLPSGGPFVRMDSHVYPDYVVPPSYDSLLGKLIVWAPTREKAIERMKRALNDTIITGVPTTIEYHKLILDVEDFKNGKVDTAFIVKHEEELAEPMEIVSVKDLTNVAA

SEQ ID NO: 14647 - protein, 541 aa, Ricinus communis
MEAALPVHKSILTTPKSPGLFMRRNGSIRGIKGSSQCSFMVGTKLNFQRQKLFIQSAAKVTHKEGGGGGAALRVSCRAEKILIANRGEIAVRVIRTAHELGIPCVAVYSTIDKDALHVKLADESVCIGEAPSSQSYLLIPNVLSAAISRGCTMLHPGYGFLAENAVFVEMCKEHGINFIGPNPDSIRVMGDKSTARETMKNAGVPTVPGSEGLLQSTEEAVKLAHEIGFPVMIKATAGGGGRGMRLAKEPGEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYRQEDIVLRGHSIECRINAEDAFKGFRPGPGRITAYLPSGGPFVRMDSHVYPDYVVPPSYDSLLGKLIVWAPTREKAIERMKRALDDTIITGVPTTIEYHKLILDIEDFKNGKVDTAFIPKHEQELQAPQKIVPVKELASATA

SEQ ID NO: 14648 - protein, 524 aa, Quercus alba
MDATLPFCKSVTSPPGLFVGRSRGIRASQCSFIVGTSRVNFPRQRVEGAQVGGYKSKKRGGALNATCRAEKILIANRGEIAVRVIRTAHEMGIPCVAVYSTIDKDALHVKLADESICIGEAPSNQSYLLIPNVLSAAISHKCTMLHPGYGFLAENAVFVEMCKEHRINFIGPNPDSIRVMGDKSTARETMKKAGVPTVPGSDGLLQSTEEAIRLANEIGYPVMIKATAGGGGRGMRLAKEPDEFVKMLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQILVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIEYHKLILDVEDFKNGKVDTAFIPKHEQELAAPHNLAKI

SEQ ID NO: 14649 - protein, 536 aa, Unknown
  Sequence found in Organisms: Brassica napus, Brassica rapa
MDASMITNCKSTASLPSLFLGRSGGSIRSSQCNVMMGKAITFPSQKTQTLKVSRKNVNRRCGGGALGATCSTGDKILVANRGEIAVRVIRTAHEMGIPCVAVYSTIDKDALHVKLADEAVCIGEAPSNQSYLVIPNVLSAAISRGCTMLHPGYGFLSENALFVEMCREHRINFIGPNPDSIRVMGDKSTARETMKNAGVPTVPGSDGLLKSTEEGVKLANEIGFPVMIKATAGGGGRGMRLANEPSEFVKLLQAAKSEAAAAFGNDGVYLEKYVQNPRHIEFQILADKFGNVVHFGERDCSIQRRNQKLLEEAPSPALTPELRKAMGDAAVAAAASIGYVGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVLVKDLTNAAA

SEQ ID NO: 14650 - protein, 540 aa, Arachis hypogaea
MESRIMAALNSVTSPHLPSHSPGLYAVENSIKSSQCSFSAGSKKVSFPRQRCSHVTKTRAARDGGAGGALGATCQAEKILVANRGEIAVRVIRTAHEMGIPCVAVYSTIDKDALHVKLADDAVCIGEAPSSQSYLLIPNVLSAAISRRCTMLHPGYGFLAENAVFVEMCREHGINFIGPNPDSIRVMGDKSTARDTMKKAGVPTVPGSDGLLQTTEEAIRLANEIGFPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFKNGKVDTAFIPKHEEELAMPPVKMVLAKEFAGVNA

SEQ ID NO: 14651 - protein, 246 aa, Artemisia annua
MDSAAVMNCSKPISTSVSSSLPGLFIGRSSGLKSSQCNFLAGSKVSFPKQRVQASQKARSSAKQAGALGVTCRAEKILVANRGEIAVRVIRTAHELGIPCVAVYSTIDKDALHVKLADESVCIGEAPSNQSYLLIPNVLSAAISRGCTMLHPGYGFLAENAVFVEMCREHGINFIGPNPDSIRVMGDKATARETMKNAGVPTVPGSEGLLSSTEEGIKLADEIGFPVMIKATAGGECVLQKNVMSL

SEQ ID NO: 14652 - protein, 534 aa, Triphysaria pusilla
MTFCSNPCVRSPPGLFMGSTTGIRSSQCSFFMAGRVNFPQQRLQASSRVGRKSGKRGGALGATCLDDKILVANRGEIAVRVIRTAHEMGIPCVAVYSTIDKEALHVKLADESVCIGEAPSSQSYLVIPNVLSAAISRGCTMLHPGYGFLSENAVFVEMCREHGINFIGPNPNSIRVMGDKSTARDTMKNAGVPTVPGSDGLLQTTDEAVKIADQIGYPVMIKATAGGGGRGMRLAKTPDEFVKLLQQAKSEAAAAFGNDGVYLEKYIQNPRHIEFQVLADKFGNVVHFGERDCSIQRRNQKLLEEAPSPALTEDLRKAMGDAAVAAAASIGYIGVGTVEFLLDERGSFYFMEMNTRIQVEHPVTEMISSVDLIEEQIRVARGEKLRYVQEDIVLKGHSIECRINAEDAFKNFRPGPGRITAYLPAGGPFVRMDSHVYPDYVVPPSYDSLLGKLIVWAPTRERAIQRMKRALNETTITGVPTTIEYHKLILDIEDFKNGKVDTAFIPKHEQELAAPVSNELAMVPKEPVNASSSA

SEQ ID NO: 14653 - protein, 535 aa, Unknown
  Sequence found in Organisms: Brassica napus, Brassica rapa
MDASMITNPKSIVSLPSLFMGRSGGSIRSSQCNVTMGQTVSFPRQKTLTLKVSRNVKRKSGGGAFAATCSSGDKILVANRGEIAVRVIRTAHEMGIPCVAVYSTIDKDALHVKLADEAVCIGEAPSNQSYLLIPNVLSAAISRGCTMLHPGYGFLAENALFVEMCREHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPDEIVPVKDLTNVAA

SEQ ID NO: 14654 - protein, 535 aa, Brassica napus
MDASMITNCKSTASLPSLFLGRSGGSLRSSQCNVMMGKTITFPSQKTQTLKVSRKNVNRRCGGGALGATCSGDKILVANRGEIAVRVIRTAHEMGIPCVAVYSTIDKDALHVKLADEAVCIGEAPSNQSYLVIPNVLSAAISRGCTMLHPGYGFLSENALFVEMCREHRINFIGPNPDSIRVMGDKSTARETMKNAGVPTVPGSDGLLKSTEEGVKLANEIGFPVMIKATAGGGGRGMRLANEPSEFVKLLQAAKSEAAAAFGNDGVYLEKYVQNPRHIEFQILADKFGNVVHFGERDCSIQRRNQKLLEEAPSPALTPELRKAMGDAAVAAAASIGYVGVGTVEFLLDERGSFYFMEMNTRIQVEHPVTEMIYSVDLIEEQIRVAMGEKLRYTQDEIVLRGHSIECRINAEDPFKGFRPGPGRITAYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVLVKDLTNAAA

SEQ ID NO: 14655 - protein, 535 aa, Centaurea maculosa
FCSSKPISSPPGLVIWRSSGIKSSQCNFLVGSKVSFPRQRVQASQRVRRSGKREGALAVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARDTMKTAGVPTVPGSDGLLQSTEEGIRLADEIGFPVMIKATAGGGGRGMRLAKERDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQDEIVLRGHSIECRINAEDAFKNFRPGPGRITSYLPSGGPFVRMDSHVYTDYVVPPSYDSLLGKLIVWAPTREKAIERMKRALNDTIITGVPTTIEYHKLILDIEDFKNGKVDTAFIPKHEEELAEPQKLIASNNAAAAAAAKEAAKSVA

SEQ ID NO: 14656 - protein, 539 aa, Glycine max
MEVTLSACKSISSPSVPVAALFAGKAGTKSSQCSFLAGANKVRFPRQVGQVSHVRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGKVDTAFIPKHEEELAMPPQKMVLANRVNELAGSTA

SEQ ID NO: 14657 - protein, 536 aa, Chenopodium quinoa
MDAFLVCKSVTAPSTTKPGLWMNQTKGFSSAPSNLAIGSRVNFPGQSVQVLKINRKARKCGGALAATCRSEKILVANRGEIAVRVIRTAHEMGIPCVAVYSTIDKDALHVKIADESVCIGEAPSNQSYLVIPNVLSAAVSRGCSMLHPGYGFLAENAVFVEMCREHGINFIGPNPDSIRVMCDKSTARETMKKAGVPTVPGSDGLLQSTDEAIKLAHEIGFPVMIKATAGGGGRGMRLAKEPDEFVKLLQQAKSEAAAAFGNDGVYLEKYVQNPRHIEFQVLADKYGNVIHFGERDCSIQRRNQKLLEEAPSPALTLELRKAMGDAAVAAAASIGYIGVGTVEFLLDERGSFYFMEMNTRIQVEHPVTEMISSVDLIEEQIRVAMGEKLRYKQEDIVLSGHSIECRINAEDAFKGFRPGPGKITSYLPAGGPFVRMDSHVYPGYVVPPSYDSLLGKLIVWAPTREKAIARMKRALDDTIITGVPTTIEYHKLILDIEDFKNGKVDTAFIPKHEQELAEPQKIVSATPAKELTGATA

SEQ ID NO: 14658 - protein, 534 aa, Aquilegia formosa
MDSMTVCKSVSSPNVPGLCVGQSRGIRSSQCSFMLGSGVMFPRQSIQSARVTHKSKKRGGALAATCRYDKILVANRGEIAVRIIRTAHEMGIPCVAVYSTIDKDALHVKLADEAVCIGEAPSNQSYLVMPNVLSAALSRKCTMLHPGYGFLAENATFVEMCREHRINFIGPNPDSIRTMGDKATARDTMKKAGVPTVPGSEGLLQTTEEAIRLADEIGYPVMIKATAGGGGRGMRLAKEPEEFVKLLQQAKSEAAAAFGNDGVYLEKYIQNPRHIEFQVLADRYNNAIHFGERDCSIQRRNQKLLEEAPSPALTPELRKAMGDAAVAAATSIGYIGVGTVEFLLDERGAFYFMEMNTRIQVEHPVTEMISSVDLIEEQIRVARGEKLRYTQDDIVLRGHSIECRINAEDAFKGFRPGPGRITAYLPSGGPFVRMDSHIYPDYVVPPSYDSLLGKLIVWAPTRERAIERMKRALSDTIITGVPTTIEYHKLILEIEDFKNGNVDTAFIPKHEKELAEPQKIVLSTPAKELTSATA

SEQ ID NO: 14659 - protein, 526 aa, Plantago ovata
MDSATMSFCSRSAVSSPHPGLLMGRRAGIMSSSQCSFMVGRKINFPRQSAQVSKMNAKSGKPGRALSVTCKAEKILVANRGEIAVRVIRTAHEMGIPCVAVYSTIDKDALHVKLADEAICIGEAPSNESYLVSLNVLAAATTYGCTMLHPGYGFLSENARFVEMCREHSINFIGPNPDSIRVMGDKSTARDTMKNAGVPTVPGSDGLLPNTEEAIRVANEIGYPVMIKATAGGGGRGMRLAKEPEEFVKLLQQAQSEAAAAFGNDGVYLEKYIQNPRHIEFQVLADKYGNVVHFGERDCSIQRRNQKLLEEAPSPALTSELRKAMGDAAVAAAASIGYVGVGTVEFLLDERGSFYFMEMNTRIQVEHPVTEMISSVDLIEEQIRVAMGEKLRYTQDDIVLKGHSIECRINAEDAFKNFRPGPGRITTYLPAGGPFVRMDSHVYQDYVVPPSYDSLLGKLIVWAPTRDRAIERMKRALSDTIITGVPTTIEYHKLILDIEDFKNGKVDTAFIPKHEEELAAPVEMEK

SEQ ID NO: 14660 - protein, 445 aa, Silene vulgaris
MGIPCVAVYSTIDKDALHVKIADEAVCIGEAPSNQSYLVIPNVLSAAVSRGCTMLHPGYGFLSENAAFVEMCKEHGINFIGPNPDSIRVMGDKSTARDTMKKAGVPTVPGSDGLLQSTDEAIKLAHEIGFPVMIKATAGGGGRGMRLAKEPDEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGTFYFMEMNTRIQVEHPVTEMISSTDLIEEQIRVAMGEKLRYKQEDIVLKGHSIECRINAEDAFKGFRPGPGKITTYLPSGGPFVRMDSHVYPGYVVPPSYDSLLGKLIVWAPTREKAIARMKRALEDTIITGVPTTIEYHKLILEVEDFKNGKVDTAFIPKHEQELAEPQHVVRATPGKELAGATA

SEQ ID NO: 14661 - protein, 535 aa, Arabidopsis lyrata
MDASMITNSKSITSPPSLVLGKTGGVIRSSLCNLMMPSKVNFPRQRTQTLKVSQKKIKRATSGGALGATCSGDKILVANRGEIAVRVIRTAHEMGIPCVAVYSTIDKDALHVKLADEAVCIGEAPSNQSYLVIPNVLSAAISRGCTMLHPGYGFLSENALFVEMCRDHGINFIGPNPDSIRVMGDKATARETMKNAGVPTVPGSDGLLQSTEEAVRVANEIGFPVMIKATAGGGGRGMRLAKEPGEFVKLLQQAKSEAAAAFGNDGCYLEKFVQNPRHIEFQVLADKFGNVVHFGERDCSIQRRNQKLLEEAPSPALTAELRKAMGDAAVAAAASIGYIGVGTVEFLLDERGSFYFMEMNTRIQVEHPVTEMIYSVDLIEEQIRVAMGEKLRYKQEDIVLRGHSIECRINAEDPFKGFRPGPGRITSYLPSGGPFVRMDSHVYSDYVVPPSYDSLLGKLIVWAPTREKAIERMKRALNDTIITGVPTTINYHKLILDVEDFKNGKVDTAFIVKHEEELAEPHEIVAVKDLTNAAV

SEQ ID NO: 14662 - protein, 526 aa, Brassica juncea
KSTASLPSLFLGRSGGSIRSSQCNVTMGQTVSFPRQKTLTLKVSRNVKRKSGGGAFAATCSSGDKILVANRGEIAVRVIRTAHEMGIPCVAVYSTIDKDALHVKLADEAVCIGEAPSNQSYLLIPNVLSAAISRGCTMLHPGYGFLSENALFVEMCREHRINFIGPNPDSIRVMGDKSTARETMKNAGVPTVPGSDGLLKSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYVGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVLVKDLTNAAA

SEQ ID NO: 14663 - protein, 516 aa, Eutrema parvulum
SLFLGRSGGIRSSQCNAMMGKMVSFPRQRTQTLKVTRKVKRSGGGALAATCSGDKILVANRGEIAVRIIRTAHEMGIPCVAVYSTIDKDALHVKLADEAVCIGEAPSNQSYLLIPNVLSAAISRGCTMLHPGYGFLAENALFVEMCRDHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYKQEEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILDVEDFKNGKVDTAFIAKHEEELAEPMEIVSVKDLTNVAA

SEQ ID NO: 14664 - protein, 540 aa, Arachis hypogaea
MEATMAACNSLSSPSVPIPGLYAGTSRGIKNSQCSFLGATKVNFPSQTMSRTCQLNHKHKTRSGALHATCQGDKILVANRGEIAVRVIRTAHELGIPCVAVYSTIDKDALHVKLADESVCIGEAPSSQSYLLIPNVLSAAISRRCTMLHPGYGFLAENAVFVEMCREHGINFIGPNPDSIRVMGDKSTARDTMKNAGVPTVPGSDGLLQSTEEAIRLANEIGFPVMIKATAGGGGRGMRLAKEPGEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGAKLRYKQEDIILRGHSIECRINAEDAFKGFRPGPGRITAYLPSGGPFVRMDSHVYPDYVVPPSYDSLLGKLIVWAPTREKAIERMKRALDDTIITGVPTTIEYHKLILDIEDFRNGKVDTAFIPKHEEELTMPPQKMVPAINKAKEFVGATV

SEQ ID NO: 14665 - protein, 499 aa, Tropaeolum majus
SSQCSFVVGNKVSFPRQRAQAAKVSRKTANNNGALSVTCRADKILVANRGEIAVRIIRTAHEMGIPCVAVYSTIDKDALHVKLADESVCIGEAPSSQSYLLIPNVLSAAISRGCTMLHPGYGFLAENAAFVEMCREHGINFIGPNPDSIRVMGDKATARETMKNAGVPTVPGSQGLLQSTEEAIKLANEIGYPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQISVAMGKKLQYKQEDIVLKGHSIECRINAEDAFKNFRPGPGRITAYLPSGGPFVRMDSHVYPDYVVPPSYDSLLGKLIVWAPTREKAIQRMKRALDDTIITGVPTTIEYHKLILDIEDFKNGKVDTAFIPKHEQELAAPSSIVAASSA

SEQ ID NO: 14666 - protein, 442 aa, Raphanus sativus
  misc_feature (116)..(116): Xaa can be any naturally occurring amino acid
  misc_feature (126)..(126): Xaa can be any naturally occurring amino acid
  misc_feature (130)..(130): Xaa can be any naturally occurring amino acid
  misc_feature (145)..(145): Xaa can be any naturally occurring amino acid
  misc_feature (160)..(160): Xaa can be any naturally occurring amino acid
MGIPCVAVYSTIDKDALHVKLADEAVCIGEAPSNQSYLLIPNVLSAAISRGCTMLHPGYGFLAENALFVEMCREHRINFIGPNPDSIRVMGDKSTARETMKNAGVPTVPGSDGLLXSTEEGVRLAXEIGXPVMIKATAGGGGRGXRLANEPSEFVKLLQXAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVPVKDLTNVAA

SEQ ID NO: 14667 - protein, 539 aa, Glycine max
MEVTLSACKSVSSPSVPVAGLFAGNGGIKSSQCSFLAGASKVRFPRQVGQVSHLRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPAEFVKFLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGKVDTAFIPKHEEELAMPPQKMVLANRVNELAGSTA

SEQ ID NO: 14668 - protein, 537 aa, Arabidopsis thaliana
MDASMITNSKSITSPPSLALGKSGGGGVIRSSLCNLMMPSKVNFPRQRTQTLKVSQKKLKRATSGGLGVTCSGGDKILVANRGEIAVRVIRTAHEMGIPCVAVYSTIDKDALHVKLADEAVCIGEAPSNQSYLVIPNVLSAAISRGCTMLHPGYGFLSENALFVEMCRDHGINFIGPNPDSIRVMGDKATARETMKNAGVPTVPGSDGLLQSTEEAVRVANEIGFPVMIKATAGGGGRGMRLAKEPGEFVKLLQQAKSEAAAAFGNDGCYLEKFVQNPRHIEFQVLADKFGNVVHFGERDCSIQRRNQKLLEEAPSPALTAELRKAMGDAAVAAAASIGYIGVGTVEFLLDERGSFYFMEMNTRIQVEHPVTEMIYSVDLIEEQIRVAMGEKLRYKQEDIVLRGHSIECRINAEDPFKGFRPGPGRITSYLPSGGPFVRMDSHVYSDYVVPPSYDSLLGKLIVWAPTREKAIERMKRALNDTIITGVPTTINYHKLILDVEDFKNGKVDTAFIVKHEEELAEPQEIVAVKDLTNATV

SEQ ID NO: 14669 - protein, 539 aa, Cajanus cajan
MEATLSACNSLTSSSVPLVGLFAGKGGIKSSQCSFLAGTNRVRFPRQVGQVSRFHKQRQTRHCGALHATCNGNKILIANRGEIAVRVIRTAHELGIPCVAVYSTIDKDALHVKLADEAVCIGEAPSSQSYLLIPNVLSAAISRRCTMLHPGYGFLAENAVFVEMCTEHGINFIGPNPDSIRVMGDKSTARETMKKAGVPTVPGSEGLLQTTEEAIRLANEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGNVDTAFIPKHEEELAMPPQKMVLSNTVKELAGSIA

SEQ ID NO: 14670 - protein, 535 aa, Aristolochia fimbriata
MDAMIVCKSVCAPRCTSNRGLFAGQARGIRSSQCSFMVGKGGPFPHQRAVQLSKKPKKKGGALSATCRDEKILVANRGEIAVRVIRTAHEMGIPCVAVYSTIDRDALHVRLADEAVCIGEAPSSQSYLFIPNVLSAAVSHNCTMLHPGYGFLAENASFVDICRAHGINFIGPNPDSIRVMGDKATARETMKKAGVPTVPGSDGLLQSTEEAVKLAHEIGFPVMIKATAGGGGRGMRLANEPDEFVKLLQQAKSEAQSAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVALGEKLEYNQEDIVLRGHSIECRINAEDAFKNFRPGPGKITAYLPSGGPFVRMDSHVYPDYVVPPSYDSLLGKLIVWAPTREKAIERMKRALDDTVITGIPTTIDYHKLILNIEDFRNGKVDTAFIPKHEKELAGPQSLVLAKSEKELASTAA

SEQ ID NO: 14671 - protein, 516 aa, Cucumis sativus
MDAAMPLCKSARAPSLTGLFAGTTNRFRSSQCTFMGANKLSFPSQRASGIKYTRKSLKNGKGLQVVCRAEKILVSNRGEIAVRIIRTAHELGIPCVAVYSTVDKDALHVKLADESVCIGEAPSSLSYLLIPNVLSAAVSRGCTMLHPGYGFLAENASFVQMCREHGINFIGPNPDSIRVMGDKSTARDTMKKAGVPTVPGSDGLLQSTEEAIKLAQEIGYPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMVFSVDLIEEQIRVAMGEKLRYKQEDIVLRGHSIECRINAEDAFKGFRPGPGRITAYLPSGGPFVRMDSHVYTNYVVPPNYDSLLGKLIVWAPTREKAIERMKRALDDTIITGVPTTIEYHKLILDVEDFKNGKVDTAFIPKHEEELA

SEQ ID NO: 14672 - protein, 523 aa, Cleome spinosa
NCKSIASPPFLFLGRTGGIKSSQCNFTLGRRVSFPSQRSQTVKVSRKAKKAGGGALAATCSGDKILVANRGEIAVRVIRTAHEMGIPCVAVYSTIDKDALHVKLADEAVCIGEAPSSQSYLLIPNVLSAAISRGCTMLHPGYGFLSENALFVEMCREHGINFIGPNPDSIRVMGDKSTARETMKNAGVPTVPGSDGLLQSTEEAIRVANEIGFPVMIKATAGGGGRGMRLAKEPEEFVKLLQQAKTEAAAAFGNDGVYLEKFVQNPRHIEFQVLADKYGNVVHFGERDCSIQRRNQKLLEEAPSPALSAELRKAMGDAAVAAAASIGYIGVGTVEFLLDERGSFYFMEMNTRIQVEHPVTEMIYSVDLIEEQIRVAMGEKLRYKQEDIVLRGHSIECRINAEDPFKGFRPGPGRITAYLPSGGPFVRMDSHVYPDYVVPPSYDSLLGKLIVWGPTREKAIERMKRALDDTIITGVPTTIDYHKLILDVEDFRNGKVDTAFIVKHEEELAAPQDIVAVTNSAAA

SEQ ID NO: 14673 - protein, 541 aa, Cicer arietinum
MEATMSACKSLTSPSTVPVTGLFAVRGGGIKSSHSQCSFLTGTNKVKFPRQTTQPCKHRQTRHCGALRATCRADKILIANRGEIAVRIIRTAHELGIPCVAVYSTVDKDALHVKLADESVCIGEAPSSQSYLLIPNVLAAAISRQCTMLHPGYGFLAENAVFVDMCREHGINFIGPNPDSIRVMGDKATARETMKKANVPTVPGSDGLLQTTEEAIRVAHEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYTQEDIVLRGHSIECRINAEDAFKGFRPGPGRITAYLPSGGPFVRMDSHIYPDYVVPPSYDSLLGKLIVWAPTREKAIERMKRALDDTIITGVPTTIDYHKLILDIEDFKNGKVDTAFIPKHEEELAVPPQQKMVLVNKVTKLTGSTA

SEQ ID NO: 14674 - protein, 371 aa, Vaccinium corymbosum
MDSAMTFCKSVHAPPGLFVGRANGIQSPRCSFNVGSRVNFLGKSTRSIQVSRKFQKRGGPLRAKCLGDKILVANRGEIAVRVIRTAHEMGIPCVAVYSTIDKDALHVKLADESVCIGEAPSNQSYLVVPNVLSAATSRGCTMLHPGYGFLSENAVFVAMCREHGINFIGPNPDSIRVMGDKSTARDTMKNAGVPTVPGSDGLLESTEEAIRVANEIGFPVMIKATAGGGGRGMRLAKEPEEFVKLLQAAKAEAAAAFGNDGVYLEKYIQNPRHIEFQVLADKYGNVVHFGERDCSIQRRNQKLLEEAPSPALTPELRKAMGDAAVAAAASIGYIGVGTVGRFLLDETGPLFMEMNTRIQVEHPCDGDDFLC

SEQ ID NO: 14675 - protein, 389 aa, Brassica napus
MLHPGYGFLAENALFVEMCREHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVPVKDLTNVAA

SEQ ID NO: 14676 - protein, 543 aa, Lotus japonicus
MEATMSACKSITSSSVPVTGLFAGRRGVKSSTQCSFLAETNKVKFPRQAAQFNKQHHQTRRHCGPLRVTCGGGSGEKILIANRGEIAVRVIRTAHELGIPCVAVYSTIDKDALHVKLADEAVCIGEAPSSQSYLLIPNVLAAAISRKCTMLHPGYGFLAENAVFVEMCREHGINFIGPNPDSIRVMGDKATARETMKKANVPTVPGSEGLLQSTEEAIRLAHEIGFPVMIKATAGGGGRGMRLAKEPEEFVKLLQQAKSEAAAAFGNDGVYLEKYIQNPRHIEFQVLADKFGNVVHFGERDCSIQRRNQKLLEEAPSPALTPELRKAMGDAAVQAAASIGYIGVGTVEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFKNGKVDTAFIPKHEEELAVPPPQKRVLSNTTKELNGATA

SEQ ID NO: 14677 - protein, 549 aa, Brassica juncea
MAGRGKQLGSGAAKKASMITNCKSTASLPSLFLGRSGGSIRSSQCNVMMGKTISFPSQKTQTLKVSRKNVNRRCGGGALGATCSTGDKILVANRGEIAVRVIRTAHEMGIPCVAVYSTIDKDALHVKLADEAVCIGEAPSNQSYLLIPNVLSAAISRGCTMLHPGYGFLAENALFVEMCREHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVLVKDLTNAAA

SEQ ID NO: 14678 - protein, 542 aa, Medicago truncatula
MEATMSAACNSLTSPSTVTGLFATRGGGLNKNSHSQCTFLTGTNKLKFPRQTTQPCKQRQTRHCGALRATCRLEKILVANRGEIAVRVIRTAHELGIPCVAVYSTIDKDALHVKLADESVCIGEAPSSQSYLVIPNVLAAATSRQCTMLHPGYGFLAENAVFVEMCRDHGVNFIGPNPDSIRVMGDKATARETMKKANVPTVPGSEGLLQTTEEAIRLAHEIGFPVMIKATAGGGGRGMRLAKEPKEFVKLLQQAKSEAAAAFGNDGVYLEKYIQNPRHIEFQVLADKYGNVVHFGERDCSIQRRNQKLLEEAPSPALTPELRKAMGDAAVQAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHIYPDYVVPPSYDSLLGKLIVWAPTREKAIERMKRALDDTIITGVPTTIDYHKLILDIEDFKNGKVDTAFIPKHEEELAVPPQQKMVLVNKVVTEPAGSTA

SEQ ID NO: 14679 - protein, 535 aa, Elaeis guineensis
MNSMITCKSACSPLGLVIGPARGIRSSQCTFMVGNAPNFHKISFPRQRAACANRKSKRSGGALHATCHDERILVANRGEIAVRVIRTAHEMGIPCVAVHSTIDEDALHVRLADEAVCIGEAPSSQSYLFIPNVLSAAVSRGCTMLHPGYGFLAENAGFVDICKEHGINFIGPNPDSIRVMGDKSTARETMKKAGVPTVPGSDGLLQSTEEAVKLAHEIGFPVMIKATAGGGGRGMRLAHEPEEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGTFYFMEMNTRIQVEHPVTEMISSTDLIEEQIRVALGERLTYKQEDIVLRGHSIECRINAEDAFKGFRPGPGKITSYLPSGGPFVRMDSHVYPGYVVPPSYDSLLGKLIVWAPTREKAIERMKRALDDTIITGIPTTIEYHKLILDIEDFRNGKVDTAFIPKHEKDLAAPQKLVLLTLEKELAGLGA

SEQ ID NO: 14680 - protein, 498 aa, Euonymus alatus
LLGSNVNFPRQRFQTAQVRCKSKKNGGALSTACRAEKILVANRGEIAVRIIRTAHEMGIPCVAVYSTIDKDALHVKLADESVCIGEAPSNQSYLVIPNVLSAAVSRRCTMLHPGYGFLAENAVFVEMCKEHGINFIGPNPDSIRVMGDKSTARDTMKNAGVPTVPGSDGLLQNTEEAIRVSNEIGFPVMIKATAGGGGRGMRLAKEPDEFVKFLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMIFSVDLIEEQIRVAMGEKLRYKQEDISLRGHSIECRINAEDAFKGFRPGPGRITSYLPSGGPFVRMDSHVYPDYVVPPNYDSLLGKLIVWAPTREKAIERMKRALDDTIITGVPTTIDYHKLILDIEDFRNGKVDTAFIPKHEQELAAPQTLVPVKELSNASA

SEQ ID NO: 14681 - protein, 497 aa, Euphorbia peplus
CSFMLGTKLNFPSHKLQASQLTHKSNKNGGALGATCRSEKILIANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARETMKNAGVPTVPGSEGLLQSTEEAVKLAHEIGFPVMIKATAGGGGRGMRLAKEPEEFVKLLQQAKSEAAAAFGNDGVYLEKYIQNPRHIEFQVLADKFGNVVHFGERDCSIQRRNQKLLEEAPSPALTPELRKAMGDAAVAAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALNDTIITGVPTTIDYHKLILEIEDFKNGKVDTAFIPKHEQELQAPQKIVPAGASA

SEQ ID NO: 14682 - protein, 240 aa, Prunus mume
MDAIMPICKTVTPTPGLFFGRTREIRSSQCSFMVGNKVNFLRQRAQGAQVSFKSRKHGGALHATCRAEKILVANRGEIAVRVIRTAHEMGIPCVAVYSTIDKEALHVKLADESVCIGEAASSQSYLVVPNVLSAAISRKCTMLHPGYGFLAENASFVEMCREHGINFIGPKPDSIRVMGDKSTARDTMKKAGVPTVPGSDGLLKSTEEGIRLADEIGFPVMIKQEAEDVACVLLKNLKSL

SEQ ID NO: 14683 - protein, 519 aa, Fagopyrum esculentum
RAPGLVVGHTAKFHSPKCTLLGSRVKFPAQKACAVHVGGKSKKRGGALAATCLGDKILVANRGEIAVRVIRTAHELGIPCVAVYSTIDKEALHVKLADEAVCIGEAPSNQSYLVIPNVLSAAVTRKCTMLHPGYGFLAENATFVEMCREHGINFIGPNPESIRVMGDKATARETMKNAGVPTVPGSEGLLQSTEEAVKLSHEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYKQEDIVLKGHSIECRINAEDAFKGFRPGPGKVTAYLPSGGPFVRMDSHVYPGYVVPPSYDSLLGKLIVWAPTREKAIARMKRALEDTIITGVPTTIDYHKLILDIEDFKDGIVDTAFIPKHEEELAAPQKPVLAIAKDLAGTSA

SEQ ID NO: 14684 - protein, 527 aa, Amborella trichopoda
MFCLLLFCGNKDLFKSGARGIISSRCSFLGGNLVTFLRPTATVTSKFKKCGGALNATCRDEKILVANRGEIAVRVIRTAHEMGIPCVAVYSTIDQDALHVRLADEAVCIGEAPSNQSYLFIPNVLSAAVSRDCTMLHPGYGFLSENATFVDICRDHGINFIGPNPDSIRVMGDKATARETMKKAGVPTVPGSDGLLQTTEEAVRLAHEIGFPVMIKATAGGGGRGMRLANEPDEFVKLLQQAKSEAAAAFGNDGVYLEKYIKNPRHIEFQVLADKHGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVALGEKLQYKQEDIVLRGHSIECRINAEDAFKGFRPGPGRITAYLPSGGPFVRMDSHIYPDYVVPPSYDSLLGKLIVWAPTREKAIERMKRALADTVITGIPTTIDYHKLILEIEDFKDGKIDTAFIPKHEKDLAAPQQLVPFTFPAKEMAGVNA

SEQ ID NO: 14685 - protein, 529 aa, Phaseolus vulgaris
MEVTLSACKSVTSPSLPVAGLSARKGGIKSSQCSFLAGTNRVKFPRQVGQVSHVRKQRQTRHCGALHATCSGDKILIANRGEIAVRVIRTARELGIPCVAVYSTIDKDSLHVKLADEAVCIGEAPSNQSYLLIPNVLSAALSRNCTMLHPGYGFLAENARFVEMCCGHRINFIGPKPDSIRVMGDKATARETMKKAGVPTVPGSEGLLQSTEEAIRLAKEIGFPVMIKATAGGGGRGMRLAKEPDEFVKLLQQAKSEAAAAFGNDGVYLEKYIQNPRHIEFQVLADKHGNIVHFGERDCSIQRRNQKLLEEAPSPALTPELRKAMGDAAVAAAASIGYIGVGTVEFLLDERGSFYFMEMNTRIQVEHPVTEMISSTDLIEEQIRVAMGEKLRFKQEDIVLRGHSIECRINAEDAFKGFRPGPGRITAYLPSGGPFVRMDSHVYPDYVVPPSYDSLLGKLIVWAPNREKAIERMKRALDDTVITGVPTTIDYHKLILDIEDFRNGKVDTAFIPKHEEELSMPPPPKIVPS

SEQ ID NO: 14686 - protein, 223 aa, Panax ginseng
MDSAAITFCSKPVYSSPPNLFMGSTCGIKSSQCIFMVGNKVKFPRQRAQASQVNRKSGKRGGALSATCRDDKILVANRGEIAVRVIRTAHEMGIPCVAVYSTIDKDALHVKLADESVCIGEAPSSQSYLVVPNVLSAAISRGCTMLHPGYGFLSENAVFVEMCREHGINFIGPNPDSIRVMGDKSTARETMKNAGVPTVPGSDGLLQIQFLIYILPKMNLQHL

SEQ ID NO: 14687 - protein, 535 aa, Musa acuminata
MDSISVCKPAFKTPGLLLRPAGGIKGLQCSFIVGYSPNFCKVCTPKKMTNRMTWRSKNHGGALNMTCQNRKILVANRGEIAVRVIRTAHEMGIPCVAVHSTIDRDALHVQLADEAVCIGEAPSSQSYLFIPNVLSAAVSRKCTMLHPGYGFLAENAGFVDICKEHGINFIGPNPDSIRVMGDKSTARETMKKAGVPTVPGSDGLLQSTEEAVKLAHEIGFPIMIKATAGGGGRGMRLAKEPEEFVKLLQQAKSEAAAAFGNDGVYLEKCIQNPRHIEFQVLADKFGNVVHFGERDCSIQRRNQKLLEEAPSPALTPELRKAMGDAAVAAASSIGYIGVGTVEFLLDEGGSFYFMEMNTRIQVEHPVTEMISSTDLIEEQIRVALGERLTYKQEDIVLRGHSIECRINAEDAFKGFRPGPGKITSYLPSGGPFVRMDSHVYPGYVVPPSYDSLLGKLIVWAPTREKAIERMKRALNDTVITGVPTTIEYHKLILDVEDFRNGKVDTAFIPKHENELAAPHKMILSASEKELSLLSN

SEQ ID NO: 14688 - protein, 572 aa, Papaver somniferum
MATILQGIGTTTSLSSTSLDSKRFESSSGKVLGGIRSDSRDISFGSSNNNKARKLVATNALTSLKSSQCSFMVGSGAIPSQKVQASHLSRKSRRRAGALSVTCRGEKILVANRGEIAVRVIRTAHEMGIPCVAVYSTIDKDALHVKLADEAVCIGEAPSNQSYLVIPNVLSAAISRGCTMLHPGYGFLAENAVFVEMCREHGINFIGPNPDSIRVMGDKSTARETMKKAGVPTVPGSDGLLQSTEEGIRLAHEIGFPVMIKATAGGGGRGMRLAKEPEEFVKLLQQAKSEAGAAFGNDGVYLEKYVQNPRHIEFQVLADMFGNVVHFGERDCSIQRRNQKLLEEAPSPALTPELRKAMGDAAVAAAASIGYIGVGTVEFLLDERGDFYFMEMNTRIQVEHPVTEMISSVDLIEEQIRVAMGEKLRYTQEEIVLRGHSIECRINAEDAFKGFRPGPGRITAYLPSGGPFVRMDSHVYPDYVVPPSYDSLLGKLIVWAPTRERAIERMKRALNDTIITGVPTTIEYHKLILEIEDFKNGKVDTAFIPKHEEELAAPQQKMVLSMQPKEPVNTTS

SEQ ID NO: 14689 - protein, 504 aa, Brassica napus
CNVTMGETVSFPRQKTLTLKVSRNVKRRSGGGAFAATCSSGDKILVANRGEIAVRVIRTAHEMGIPCVAVYSTIDKDALHVKLADEAVCIGEAPSNQSYLLIPNVLSAAISRGCTMLHPGYGFLAENALFVEMCREHRINFIGPNPDSIRVMGDKSTARETMKNAGVPTVPGSDGLLQSTEEGVRLANEIGYPVMIKATAGGGGRGMRLANEPSEFVKLLQQAKSEAAAAFGNDGVYLEKYVQNPRHIEFQILADKFGNVVHFGERDCSIQRRNQKLLEEAPSPALTPELRKAMGDAAVAAAASIGYIGVGTVEFLLDERGSFYFMEMNTRIQVEHPVTEMIYSVDLIEEQIRVAMGEKLRYTQDEIVLRGHSIECRINAEDPFKGFRPGPGRITSYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVPVKDLTNVAA

SEQ ID NO: 14690 - protein, 445 aa, Elaeis guineensis
MGIPCVAVHSTIDQDALHVRLADEAVCIGEAPSSQSYLFIPNVLSAAVSRGCTMLHPGYGFLAENAGFVDICKEHGINFIGPNPDSIRVMGDKSTARETMKKAGVPTVPGSDGLLQSTEEAVKLAHEIGFPVMIKATAGGGGRGMRLAYEPEQFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVALGERLTYKQEDIVLRGHSIECRINAEDAFKGFRPGPGKITSYLPSGGPFVRMDSHVYPGYVVPPSYDSLLGKLIVWAPTREKAIERMKRALDDTIITGIPTTIEYHKLILDIEDFRNGKVDTAFIPKHEKDLTAPHKLVLSTSEKELAGVGA

SEQ ID NO: 14691 - protein, 535 aa, Phalaenopsis aphrodite
MDSMVMFKSISSMQKTMFLRTTQGNRSSQCNFMVGNLPNFQKIFLPRQRAACKTQRFKNSGGALRATCHDEKILVANRGEIAVRVIRTAHEMGIPCVAVHSTIDKDALHVRLADEAVCIGEAPSSQSYLFIPNVLSAAVSHRCTMLHPGYGFLAENAGFVDICREHGINFIGPNPDSIRVMGDKSTARETMKKAGVPTVPGSEGLLQSTEEAIKLAHEIGFPVMIKATAGGGGRGMRLALEPGEFVKLLQQAKSEAAAAFGNDGVYLEKYIQNPRHIEFQVLADKYGNVVHFGERDCSIQRRNQKLLEEAPSPALTQELRKAMGDAAVAAAASIGYIGVGTVEFLLDERGSFYFMEMNTRIQVEHPVTEMISSTDLIEEQIRVALGERLSFEQEDIILRGHSIECRINAEDPFKGFRPGPGRITAYLPSGGPFVRMDSHIYPDYVVPPSYDSLLGKLIVWAPTRDKAIERMKRALNDTVITGVPTTIEYHKLILDVEDFKNGKVDTAFIPKHENELTEPQKMVLANPRKEVVGVN

SEQ ID NO: 14692 - protein, 394 aa, Chenopodium quinoa
MQYVASWVWISAENAVFVEMCREHGINFIGPNPDSIRVMGDKSTARETMKKAGVPTVPGSDGLLQSTDEAIKLAHEIGFPVMIKATAGGGGRGMRLAKEPDEFVKLLQQAKSEAAAAFGNDGVYLEKYVQNPRHIEFQVLADKYGNVIHFGERDCSIQRRNQKLLEEAPSPALTLELRKAMGDAAVAAAASIGYIGVGTVEFLLDERGSFYFMEMNTRIQVEHPVTEMISSVDLIEEQIRVAMGEKLRYKQEDIVLSGHSIECRINAEDAFKGFRPGPGKITSYLPAGGPFVRMDSHVYPGYVVPPSYDSLLGKLIVWAPTREKAIARMKRALDDTIITGVPTTIEYHKLILDIEDFKNGNVDTAFIPKHEQELAEPQKIVPATPAKELTGATA

SEQ ID NO: 14693 - protein, 476 aa, Panax ginseng
GGALSATCRDDKILVANRGEIAVRVIRTAHEMGIPCVAVYSTIDKDALHVKLADESVCIGEAPSSQSYLVVPNVLSAAISRGCTMLHPGYGFLSENALFVEMCREHGINFIGPNPDSIRVMGDKSTARDTMKNAGVPTVPGSDGLVQSTEEAIRVADEIGYPVMIKATAGGGGRGMRLAKEPEEFVKLLQAAKSEAAAAFGNDGVYLEKYIQNPRHIEFQVLADKFGNVVHFGERDCSIQRRNQKLLEEAPSPALTSELRKAMGDAAVAAAASIGYIGVGTVEFLLDERGSFYFMEMNTRIQVEHPVTEMISSVDLIEEQIRVARGEKLRYKQEDIVLRGHSIECRINAEDAFKNFRPGPGRITAYLPSGGPFVRMDSHVYPDYVVPPSYDSLLGKLIVWAPTRERAIARMKRALDDTIITGVPTTIEYHKLILEVEDFKNGKVDTAFIPKHEHELEAPQKIVSATPAKELANTAA

SEQ ID NO: 14694 - protein, 531 aa, Musa acuminata
MDLTVVFKPALSPPGLFPRHAGGMKSSQCSFSVGYSPVFHKVCSSRQMTAHTNRRLKYNGGALNATCQGGKILVANRGEIAVRVIRTAHEMGIPCVAVHSTIDRDALHVRLADEAVCIGEAPSSQSYLFIPNVLSAAVSHRCTMLHPGYGFLAENAGFVDICREHRINFIGPNPDSIRVMGDKSTARETMKKAGVPTVPGSDGLLQSTEEAVKLAHEIGFPVMIKATAGGGGRGMRLAKEPEEFVKLLLQAKSEAAAAFGNDGVYLEKYIQNPRHIEFQVLADKYGNVVHFGERDCSIQRRNQKLLEEAPSPALSPELRKAMGDAAVAAAASIGYIGVGTVEFLLDERGSFYFMEMNTRIQVEHPVTEMISSTDLIEEQIRVALGERLTYKQEDIVLRGHSIECRINAEDAFKGFRPGPGRITSYLPSGGPFVRMDSHIYPGYVVPPSYDSLLGKLIVWAPTREKAIERMKRALNDTIITGVPTTIEYHKLILNVEDFRNGKVDTAFIPKHENELAAPQKMILSTAAAMSN

SEQ ID NO: 14695 - protein, 258 aa, Centaurea maculosa
SAKREGALAVTCRAEKILVANRGEIAVRVIRTAHELGIPCVAVYSTIDKDALHVKLADESVCIGEAPSSQSYLLIPNVLSAAISRGCTMLHPGYGFLAENAVFVEMCREHGINFIGPNPDSIRVMGDKATARDTMKTAGVPTVPGSDGLLQSTEEGIRLADEIGFPVMIKATAGGGGRGMRLAKERDEFVKLLQQAKSEAAAAFGNDGVIWRSTFKTQGTLNSRFLQINSEMLFTLESVTAVFREGTKSCLKKHPRLH

SEQ ID NO: 14696 - protein, 553 aa, Trifolium pratense
MEATMSAACKSLASPSTVPVTGLFTARGGLKSSNSHSRCSFLTGNNKVKFPRQITQHSSKQQHRRRALHSYALPVTCRAEKILIANRGEIAVRVIRTAHELGIPCVAVYSTIDKDALHVKLADEAVCIGEAPSSQSYLVIPNILAAASGRNCTMLHPGYGFLAENAVFVEMCREHGINFIGPNPDSIRVMGDKATARETMKKANVPTVPGSEGLLQSTEEAIRLAHEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVQAAASIGYIGVGTVEFLLDERGSFYFMEMNTRIQVEHPVTEMISSVDLIEEQIRVALGEKLRYKQEDIVLRGHSIECRINAEDAFKGFRPGPGRITAYLPSGGPFVRMDSHIYPDYVVPPSYDSLLGKLIVWAPTREKAIERMKRALDDTIITGVPTTIDYHKLILDIEDFKTGKVDTAFIPKHEEELAVPPPPKMVLVNKVTEPEPEREPVALPA

SEQ ID NO: 14697 - protein, 555 aa, Trigonella foenum-graecum
MEATMSASSCKSLTSPSIGLFAAAKGGGGGGLKLNSHSQCTFLTGTNKVKFPRQTTQPCKQRQTRHCGALRATCRAEKILVANRGEIAVRVIRTAHELGIPCVAVYSTIDKDALHVKLADEAVCIGEAPSSQSYLLIPNVLAAATSRKCTMLHPGYGFLAENAVFVDMCKEHRINFIGPNPDSIRIMGDKATARDTMKKANVPTVPGSEGLLQTTEEAIRLAHEIGFPVMIKATAGGGGRGMRLAKEPEEFVKLLQQAKSEAAAAFGNDGVYLEKYIQNPRHIEFQVLADKYGNVVHFGERDCSIQRRNQKLLEEAPSPALTPELRKAMGDAAVQAAASIGYIGVGTVEFLLDERGSFYFMEMNTRIQVEHPVTEMISSVDLIEEQIRVAMGEKLRYKQEDIVLRGHSIECRINAEDAFKGFRPGPGRITAYLPSGGPFVRMDSHIYPDYVVPPSYDSLLGKLIVWAPTREKAIERMKRALDDTIITGVPTTIDYHKLILDIEDFKNGKVDTAFIPKHEEELAVPPQQKMVLVNKVVTEPEPEPESEPEPAATTA

SEQ ID NO: 14698 - protein, 531 aa, Zostera marina
MDAMIACKAAPTSASPGLFVASTRGIRSSQCSFMIGGRAGSFPNVLLTSKCLTRVSRKSKRYGGALGATCRDEKILVANRGEIAVRVIRTAHEMGIPCVAVHSTIDRDALHVQLADEAVCIGEAQSSQSYLSIPNILSAAISHECTMLHPGYGFLSENASFVDMCREQGINFIGPDADSIRAMGDKSTARETMKKAGVPTVPGSDGLLQSTEEAVKVADEIGYPVMIKATAGGGGRGMRLAKEPEEFIRLLQQAKSEAAAAFGNDGVYLEKFIQNPRHIEFQVLADKYGNVVHFGERDCSIQRRNQKLLEEAPSPVLTTELREAMGNAAIAAAASIGYIGVGTIEFLLDERGSFYFMEMNTRIQVEHPVTEMISSADLIEEQINVALGKRINYKQEDIVLRGHSIECRINAEDAFKGFRPGPGRITSYLPAGGPFVRMDSHVYTDYVVPPNYDSLLGKLIVWAPTREKAIERMKRALNDTVITGIPTTIEYHKLILEIEDFQNGIVDTAFIQKHEEELAEPHNFVLTSYLN

SEQ ID NO: 14699 - protein, 288 aa, Solanum phureja
MMIFTTPYFSFPPISISISNKSPNPKLIPAGINYVIRCSTSTPGLPVTTERLRNDTPLTGGAYDFEKATTSLTKKVLDSPKKVTIVRHGLSSWNEESRVQGSSNLSILSEKGTMQAERCKMALSDMHFDQCFSSPISRAKTTAEIIWKGKEEPLVFLDSLKEAHLFFLEGMKNEDAKRIYPKEYTTWREDPSNFCVDGVYPLQKLWGRAHEAWEEILLTPGENFLVVTHKSILRALICTALGLGPERFRSVDINNGGLCVFKFNKEGEAMLQSLNMTAHMYTDHVYHY

SEQ ID NO: 14700 - protein, 291 aa, Nicotiana tabacum
  misc_feature (32)..(32): Xaa can be any naturally occurring amino acid
  misc_feature (241)..(241): Xaa can be any naturally occurring amino acid
MSSGTILITPYFSFPSISNSNKFPRPKLHSSXNINYSIRCSTSSPELPVTTTERFRYDTPLTGGAFDFEKATTSLTRKALACPKKVTLVRHGLSSWNEEGRVQGSSNLSILSEKGAMQAERCKMALSDMHFDQCFSSPISRAKTTAEIIWQEKEEPLVFLDSLKEAHLYFLEGMKNEDAKRIYPKEYTTWREDPSNFCVDGVYPLQKLWGRAYEAWEEILLTPGENFLVVTHKSILRALIXTALGLGPERFRSVDINNGGLCVFKFNKQGEAMLHSLNMTAHMYTDHIYHY

SEQ ID NO: 14701 - protein, 291 aa, Nicotiana benthamiana
MSSGTILITPYFSFPSISNSNKFPRPKLHSSSSINYTIRCSTSSPELPVTTTERFRYDTPLTGGAFDFDKATTSLTRKALACPKKVTIVRHGLSSWNEEGRVQGSSNLSILSEKGAMQAERCKMALSDLHFDQCFSSPISRAKTTAEIIWQGKEEPLVFLDSLKEAHLYFLEGLRNEDAKRIYPKEYTTWREDPSNFCVDGVYPLQKLWGRAYEAWEEILLTPGENFLVVTHKSILRALICTPLGLGPERFRSVDINNGGLCVIKFNKQGEAMLHSLNMTAHMYTDHIYHY

SEQ ID NO: 14702 - protein, 375 aa, Solanum phureja
MEAVREQYNRAKPFLAVIFLQFGLAGMDILTKVALNEGMSNYVFVVYRHAVATLVIAPFAIILDKKVRPKMTPSIFAKLVLLSLLEPVIDQNLYSIGLKYTTATFAAAMCNILPAITFIMAWIFRLEKVKLTSIRSQAKLVGTVATVAGAMIMTLVRGPIVELFWTAGNAGHDSQSGGLNLSHAIKGSIMITIGCFSWAAFMILQAITLRTYPAELSLTAWICLLGTTEGAIVAMVMERGKPAVWAINWDSKFLAAVYSGIFCSGLAYYIQGVIMKDRGPVFVTAFNPLSMVIVAILSTIILREQLNLGRVLGAVVIVVGLYIVLWGKSKDHKSPSIDEQAIPTHETKIDKETLSQPVVHINSSRGTTAPEDETI

SEQ ID NO: 14703 - protein, 379 aa, Solanum tuberosum
MEAVREQYNRAKPFLAVIFLQFGLAGMDILTKVALNEGMSNYVFVVYRHAVATLVIAPFAIILDKKVRPKMTPSIFAKLVLLSLLEPVIDQNLYSIGLKYTTATFAAAMCNILPAITFIMAWIFRLEKVKLTSIRSQAKLVGTVATVAGAMIMTLVRGPIVELFWTAGKAGHDSQSGGLNLSHAIKGSIMITIGCFSWAAFMILQAITLRTYPAELSLTAWICLLGTTEGAIVAMVMERGKPAVWAINWDSKFLAAVYSGIFCSGLAYYIQGVIMKDRGPVFVTAFNPLSMVIVAILSTIILREQLNLGRVLGAVVIVVGLYIVLWGKSKDHKSPSIDEQAIPTHEMTHETKIDKETLSQTVVHINSSRGTTATEDETI

SEQ ID NO: 14704 - protein, 379 aa, Solanum melongena
MEAVCELYNKAKPFLAVIFLQFGLAGMDILTKVALNEGMSNYVFVVYRHAVATLVIAPFAIFLDKKVRPKMTLSIFAKLVLLSILEPVIDQNLYSIGLKYTTATFAAAMCNILPAITFIMAWIFRLEKVKLTSIRSQAKIVGTVATVAGAMIMTLVRGPIVELFWTTGNAGHESQSGGLNLSHAIKGSIMITIGCFSWAAFMILQAITLRTYPAELSLTAWICFLGTAEGAIVAMVMERGKTAVWAINWDSKFLAAVYSGIFCSGLAYYIQGVIMKDRGPVFVTAFNPLSMVIVAILSTLILREQLNLGRVLGAIVIVVGLYIVLWGKSKDHKTPSIDEQAIPTQEMTHETKIDRENLSQTVVYINPSSGKTAKEDESM

SEQ ID NO: 14705 - protein, 353 aa, Nicotiana benthamiana
MDILTKMALNEGMSNYVFVVYRHAVATLAISPFAIILDKKIRPKMTLSIFTKLVLLSILEPVIDQNLYSIGLKYTTATFAAAMCNILPAITFIMAWIFRLERVKLTSIRSQAKIIGTVATVAGAMIMTLVRGPVIELFWTNGNSSHESQSGGLNLSHAIKGSLMITIGCFSWAAFMILQAITLRTYPAELSLTAWICLLGTAEGAIVATVMERGKAAVWAIKWDTKFLAAVYSGIFCSGLAYYIQGVIMKDRGPVFVTAFNPLSMVIVAILSSFILREQMNLGRVLGAVVIVLGLYIVLWGKSKDQKSPSANEQAIPTQETTHENKIDKENLSQTIIHISPSRGTTVTKDERI

SEQ ID NO: 14706 - protein, 351 aa, Nicotiana benthamiana
MDILTKMALNEGMSNYVFVVYRHAVATLAIAPFAIILDKKIRPKMTLSIFTKLVLLSILEPVIDQNLYSIGLKYTTATFAAAMCNILPAITFIMAWIFRLERVKLTSIRSQAKIIGTVATVAGAMIMTLVRGPVIELFWAKGNSSHESQSGGLNLSHAIKGSLMITIGCFSWAAFMILQAITLRTYPAELSLTAWICLLGTAEGAIVAMVMERGKAAVWAIKWDTKFLAAVYSGIFCSGLAYYIQGVIMKDRGPVFVTAFNPLSMVIVAILSSFILREQMNLGRALGAVVIVLGLYIVLWGKSKDQKSPSADEQAIPTQETTHENKIDKENLSIHISPSRGPTVTKEERIK

SEQ ID NO: 14707 - protein, 381 aa, Solanum tuberosum
MNSPALSLRHNHFLNGGSALASGIRLPRSISSPFRVRMSLQENGPSVAVVGVTGAVGQEFLSVLSDRNFPYRSIKLLASKRSAGKSMKFEERDYTVEELTEDSFDGIDIALFSAGGSISKKFGPLAAQKGTIVVDNSSAFRMDENVPLVIPEVNPEAMAHVKLGSGKGALIANPNCSTIICLMAVTPLHRRAKVKRMVVSTYQAASGAGAAAMEELVQQTREVLEGKEPTCNIFNQQYAFNLFSHNAPIQPNGYNEEEMKLVKETRKIWSDKDVKVTATCIRVPVMRAHAESVNLQFENPLDENTARDILKNAPGIVVVDDRASNRFPTPLEVSNKDDVAVGRVRRDVSQDGDYGLDIFVCGDQIRKGAALNAVQIAEMLL

SEQ ID NO: 14708 - protein, 387 aa, Solanum phureja
MNSPALSLRHNHFLNGGSALASGIRLPRSISSSSTSSSPFRVRMSLQENGPSVAVVGVTGAVGQEFLSVLSDRNFPYRSIKLLASKRSAGKSMKFEERDYTVEELTEDSFDGIDIALFSAGGSISKKFGPLAAQKGTIVVDNSSAFRMDENVPLVIPEVNPEAMAHVKLGSGKGALIANPNCSTIICLMAVTPLHRRAKVKRMVVSTYQAASGAGAAAMEELVQQTREVLEGKEPTCNIFNQQYAFNLFSHNAPIQPNGYNEEEMKLVKETRKIWSDKDVKVTATCIRVPVMRAHAESVNLQFENPLDENTARDILKNAPGIVVVDDRASNRFPTPLEVSNKDDVAVGRVRRDVSQDGDYGLDIFVCGDQIRKGAALNAVQIAEMLL

SEQ ID NO: 14709 - protein, 385 aa, Solanum melongena
MNSPALSLRHNQFLNGGTALASGIGLSRYICSSTSSPFRVRMSLQETGPSVAVVGVTGAVGQEFLSVLSDRNFPYRSLKLLASKRSAGKWMKFEERDYTVEELTEDSFDAIDIALFSAGGSISKKFGPLAAQKGTIVVDNSSAFRMDENVPLVIPEVNPEAMAHVKLGSGKGALIANPNCSTIICLMAVTPLHRRAKVKRMVVSTYQAASGAGAAAMEELVQQTREVLEGKEPTCNIFNQQYAFNLFSHNAPIQSNGYNEEEMKLVKETRKIWSDNDVKVTATCIRVPVMRAHAESVNLQFENPLDENTAREILKNAPGIVVVDDRASNRFPTPLEVSNKDDVAVGRVRRDVSQDGDYGLDIFVCGDQIRKGAALNAVQIAEMLL

SEQ ID NO: 14710 - protein, 381 aa, Nicotiana benthamiana
MNTPALSVRHNHFLYRGGTTIPRPRSITTSTSPFRVRMSLQENGPSVAVVGVTGAVGQEFLSVLSDRDFPYRSMKLLASKRSAGKSMKFEDRDYTVEELTEDSFVGIDIALFSAGGSISKKFGPLAAQKGTIVVDNSSAFRMYENVPLVIPEVNPEAMAHVKLGSGKGALIANPNCSTIICLMAVTPLHRCAKVKRMVVSTYQAASGAGAAAMEELVQQTREVLEGKEPTCNIFNQQYAFNLFSHNAPVQPNGYNEEEMKLVKETRKIWNDMDVKVTATCIRVPVMRAHAESVNLQFEKPLDEDTARDILKNAPGIIIIDDRASNRFPTPLEVSNKDDVAVGRVRRDVSQDGDYGLDIFVCGDQIRKGAALNAVQIAEMLL

SEQ ID NO: 14711 - protein, 380 aa, Ipomoea nil
MKLSTLSLRHHQFLPGTAAIPTPRSISSSASASRVRMSLREDAPSVAIVGVTGAVGQEFLSVLSDRDFPYRSLKLLASKRSAGRGLAFEGKQYTVEELTEESFEGVDIALFSAGGSISKKFGPIAARKGTIVVDNSSAFRMDDGVPLVIPEVNPDAMAHIKVGSGKGAIIANPNCSTIICLMAATPLHLRAKVKRMVVSTYQAASGAGAAAMEELVLQTREVLEGKEPTCNIFKQQYAFNLFSHNASIQSNGYNEEEMKLVKETRKIWNDKDVKVTATCIRVPVMRAHAESVNLQFEKPLDEETAKDILKNAPGIVVVDDRAANRFPTPLEVSNKDDVAVGRIRRDISQDGDYGLDIFVCGDQIRKGAALNAVQIAEKLL

SEQ ID NO: 14712 - protein, 392 aa, Chenopodium quinoa
MSAAMNLAAGKVHTPFLSGTTTTTSTTSVRRTLLPLPRTSTPSSSAIRMSLRDDGPSLAVVGVTGAVGQEFLSVLSDRDFPYRSLKLLASKRSAGKEMTFEGRTYIVEELDEDSFDGIDIALFSAGGSISKQFGPLAVEKGTIVVDNSSAFRMVDDVPLVIPEVNPQAMAHIKLGSGKGALIANPNCSTIICLMAATPLHRRAKVTRMVVSTYQAASGAGAAAMEELELQTREVLEGKPPTCNIFSQQYAFNLFSHNAPILSNGYNEEEMKLVKETRKIWDDITVRVTATCIRVPVMRAHAESVNLQFETPLDEDTAREILESAPGVVVIDDRASNHFPTPLEVSNKDAVAVGRIRRDVSLDGDNGLDIFVCGDQIRKGAALNAVQIAEMLL

SEQ ID NO: 14713 - protein, 261 aa, Orobanche aegyptiaca
MKLQTLSLRHHLTTSFLHNGATSLSVSRSTRVTNAPFTVRMSLREDGPSVAVVGVTGAVGQEFLSVLSDRDFPYRSLKLLASKRSAGKKVTYENRDYTVEELTEDSFDAVDIALFSAGGSISKKFGPIAVDKGTIVVDNSSAFRMDDGIPLVIPEVNPEAMEGIKLKGGKGRLLQIQIARLLYASWLSPHCIVRQKYHEWLSVHTRQLVVQVLQQWKNLNSRLVRCWKENSLLVTFLSNSMPLTCSHIMHLFFPMDTTKRR

SEQ ID NO: 14714 - protein, 376 aa, Cicer arietinum
MASLSLLRQNSFFSATLSSQPKPKYASPGRVRMSLQENAPTIAVVGVTGAVGQEFLSVLSDRDFPYSSIKMLASKRSAGRRLTFEDKEYVVEELTAESFDGVDIALFSAGGSISKEFGPIAVERGAIVVDNSSAFRMDENVPLVIPEVNPEAMANIKVGMGKGALIANPNCSTIICLMAATPLHRRAKVLRMVVSTYQAASGAGAAAMEELVLQTREVLEGKPPTCKIFNRQYAFNLFSHNAPVLSNGYNEEEMKLVKETRKIWNDKDVKVTATCIRVPVMRAHAESVNLQFETPLDEDTARDILKNAPGVVVIDDRESNNFPTPLEVSNKDDVAVGRIRRDLSQDGNQGLDIFVCGDQIRKGAALNAIQIAEMLL

SEQ ID NO: 14715 - protein, 379 aa, Vitis vinifera
MKAPALAHHHHLLSATRIPRTNLRPRTATPTSTIRMSLQENAPSLAVVGVTGAVGQEFLSVLSDRGFPYRSIKMLASKRSAGKHLTFEDNDYVIEELTADSFDGIDIALFSAGGSISKQFGPIAVDRGSIVVDNSSAFRMDENVPLVIPEVNPDAMKHIKLGSGKGALIANPNCSTIICLMAATPLHRCAKVVRMVVSTYQAASGAGAAAMEELELQTREVLEGKQPTCKIFKQQYAFNLFSHNAPVLPNGYNEEEMKLVKETRKIWNDMNVKVTATCIRVPVMRAHAESVNLQFENPLDEDKARDILKNAPGVVVIDERPSNNFPTPLEVSNKDDVAVGRIRRDVSQDGNFGLDIFVCGDQIRKGAALNAIQIAEMLL

SEQ ID NO: 14716 - protein, 375 aa, Arabidopsis lyrata
MATFTHQTPQTHFLSRLPLRATPRHFSARVKMSLQESAPSLAVVGVTGAVGQEFLSVLSDRDFPYSSVKMLASKRSAGKRVAFDGREYTVEELTAESFDGVDIALFSAGGSISKEFGPLAAEKGTIVVDNSSAFRMVDGVPLVIPEVNPEAMKGIKVGMGKGALIANPNCSTIICLMAVTPLHRHAKVKRMVVSTYQAASGAGAAAMEELVQQTREVLEGKPPTCNIFGQQYAFNLFSHNAPILDNGYNEEEMKLVKETRKIWNDTEVKVTATCIRVPVMRAHAESVNLQFENPLDENTAREILKKAPGVYIIDDRASNTFPTPLDVSNKDDVAVGRIRRDVSQDGDFGLDIFVCGDQIRKGAALNAVQIAEMLL

SEQ ID NO: 14717 - protein, 375 aa, Vigna unguiculata
MASLSVSRHSHLLSGLLPARSKPTSGPTRVRMSLRDDGPSIAVVGVTGAVGQEFLSVLSDRDFPYRSIKMLASQRSAGRRITFEDRDYVVEELTADSFDGVDIALFSAGGSISKKFGPAAVDRGTVVVDNSSAFRMDEKVPLVIPEVNPEAMQHIKAGTGKGALIANPNCSTIICLMAATPLHRRAKVLRMVVSTYQAASGAGAAAMEELELQTREVLEGKPPTCKIFNRQYAFNLFSHNASVLSNGYNEEEMKMVKETRKIWNDKEVKVTATCIRVPVMRAHAESVNLQFENPLDENTARDILKNAPGVVVIDDRESNHFPTPLEVSNKDDVAVGRIRQDLSQDGNQGLDIFVCGDQIRKGAALNAIQIAEMLL

SEQ ID NO: 14718 - protein, 377 aa, Eucalyptus grandis
MAALTRITHKAHLPFPAATAAGGGRRPRAARIRMSLQENGPSLAVVGVTGAVGQEFLSVLSDRDFPYRSIKMLASKRSAGKRMTFEDRDYVVEELTADSFEGVDIALFSAGGSISKELGPIAVEKGTIVVDNSSAFRMVEGVPLVIPEVNPEAMEGVRLGTGKGALIANPNCSTIICLMAATPLHRRAKVVRMVVSTYQAASGAGAAAMEELELQTREVLEGKPPTCNIFKLQYAFNLFSHNAPVLSNGYNEEEMKLVKETRKIWNDTNVKVTATCIRVPVMRAHAESVNLQFENPLDEETAKDILKNAPGVVVIDDRAANHFPTPLEVSNKDDVAVGRIRRDVSQDGNYGLDIFVCGDQIRKGAALNAVQIAEMLL

SEQ ID NO: 14719 - protein, 376 aa, Unknown
  Sequence found in Organisms: Citrus clementina, Citrus sinensis
MATFSSHQTQTHFISKLPANKPRTKPMFTRVRMSYQESAPSVAVVGVTGAVGQEFLSVLSDRDFPYRSIKMLASKRSAGKQLSFQDKAYTVEELTEDSFDGVDIALFSAGGSISKKFGPIAVEKGSIVVDNSSAFRMVENVPLVIPEVNPEAMSGIKVGMGKGALIANPNCSTIICLMAATPLHRRAKVTRMVVSTYQAASGAGAAAMEELELQTREVLEGKPPTCKIFSQQYAFNLFSHNAPVLENGYNEEEMKMVKETRKIWNDKDVRVTATCIRVPVMRAHAESVNLQFEKPLDEDTARDILKNAPGVVVIDDRASNHFPTPLEVSNKDDVAVGRIRRDVSQDGNHGLDIFVCGDQVRKGAALNAVQIAEMLL

SEQ ID NO: 14720 - protein, 383 aa, Panax ginseng
MNSPTLAHHQFLHGGGGATFSLLHPKPAFSTTSSPFTVCMSLREDAPSLAVVGVTGAVGQEFLSVLSDRAFPYRSIKMLASKRSAGKKFIFEDNDYVVEELTPDSFSGVDIALFSAGGSISKQLGPIAADCGTIVVDNSSAFRMDENVPLVIPEVNPDAMSGIKWGSGKGAIIANPNCSTIICLMAATPLHRRAKVVRMVVSTYQAASGAGAAAMEELEQQTREVLEGKQPTCKIFKRQYAFNLFSHNAPVLSNGYNEEEMKLVKETRKIWNDTSVKVTATCIRVPVMRAHAESVNLQFEKPLDEDTARDILKNAPGVVVIDDRASNHFPTPLEVSNKDNVAVGRIRRDVSQDGDYGLDIFVCGDQIRKGAALNAVQIAEMLL

SEQ ID NO: 14721 - protein, 384 aa, Arnica chamissonis
MQSPAVAHRHFFDGAAAASSSSPLLRLKPTPSVSSPFSVRMSLREDAPSIAVVGVTGAVGQEFLSVLSDRSFPYRSIKMLASKRSAGKKYTFEDNEYVVEELTADSFRDVDIALFSAGGSISKEFGPIAASFGTVVVDNSSAFRMDDGVPLVIPEVNPDAMSHINLGTGKGALIANPNCSTIICLMAATPLHRRAKVLRMVVSTYQAASGAGAAAMEELELQTREVLEGKRPTCNIFKQQYAFNLFSHNAPVLPNGYNEEEMKLVKETRKIWNDKGVKVTATCIRVPVMRAHAESVNLQFASPLDENEARDILKKAPGVVVIDDRASNHFPTPLEVSNKDDVAVGRIRQDESQDGNYGLDIFVCGDQIRKGAALNAVQIAEMLL

SEQ ID NO: 14722 - protein, 377 aa, Glycine max
MSSLSVSRHNHLFSGPLPARPKPKPSFSSSRIRMSLQENGPSIAVVGVTGAVGQEFLSVLSDRDFPYSSIKMLASKRSAGRRITFEDRDYVVEELTAESFDGVDIALFSAGGSISKYFGPIAVDRGTVVVDNSSAFRMDENVPLVIPEVNPEAMQNIKAGTGKGALIANPNCSTIICLMAATPLHRRAKVLRMVVSTYQAASGAGAAAMEELQLQTREVLEGKPPTCKIFNRQYAFNLFSHNASVLSNGYNEEEMKMVKETRKIWNNKDVKVTATCIRVPVMRAHAESVNLQFETPLDEDTARDILKNAPGVVVIDDRESNHFPTPLEVSNKDDVAVGRIRQDLSQDGNQGLDIFVCGDQIRKGAALNAIQIAEMLL

SEQ ID NO: 14723 - protein, 385 aa, Panax ginseng
MNSPALAHHQFLHGGGGATFSLLHPKPYFPTTTTSSPFTVSMSLREDAPSLAVVGVTGAVGQEFLSVLSDRSFPYRSIKMLASKRSAGKKFIFEDNDYVVEELTPDSFSGVDIALFSAGGSISKQLGPIAADCGTIVVDNSSAFRMDENVPLVIPEVNPDAMSGIKWGSGKGAIIANPNCSTIICLMAATPLHRRAKVVRMVVSTYQAASGAGAAAMEELEQQTREVLEGKQPTCKIFKRQYAFNLFSHNAPVLSNGYNEEEMKLVKETRKIWNDTSVKVTATCIRVPVMRAHAESVNLQFEKPLDEDTARDILKNAPGVVVIDDRASNHFPTPLEVSNKDNVAVGRIRRDVSQDGDYGLDIFVCGDQIRKGAALNAVQIAEMLL

SEQ ID NO: 14724 - protein, 376 aa, Glycine max
MASLSVLRHNHLFSGPLPARPKPTSSSSSRIRMSLRENGPSIAVVGVTGAVGQEFLSVLSDRDFPYRSIHMLASKRSAGRRITFEDRDYVVQELTPESFDGVDIALFSAGGSISKHFGPIAVNRGTVVVDNSSAFRMDEKVPLVIPEVNPEAMQNIKAGTGKGALIANPNCSTIICLMAATPLHRRAKVLRMVVSTYQAASGAGAAAMEELELQTREVLEGKPPTCKIFNRQYAFNLFSHNASVLSNGYNEEEMKMVKETRKIWNDKDVKVTATCIRVPIMRAHAESVNLQFERPLDEDTARDILKNAPGVVVIDDRESNHFPTPLEVSNKDDVAVGRIRQDLSQDGNQGLDIFVCGDQIRKGAALNAIQIAEMLL

SEQ ID NO: 14725 - protein, 375 aa, Arabidopsis thaliana
MATFTHQTPQTHFLSRLPLRAKPRHFSARVKMSLQESAPSLAVVGVTGAVGQEFLSVLSDRDFPYSSIKMLASKRSAGKRVAFDGHEYTVEELTADSFNGVDIALFSAGGSISKEFGPLAAEKGTIVVDNSSAFRMVDGVPLVIPEVNPEAMKGIKVGMGKGALIANPNCSTIICLMAVTPLHHHAKVKRMVVSTYQAASGAGAAAMEELVQQTREVLEGKPPTCNIFGQQYAFNLFSHNAPILDNGYNEEEMKLVKETRKIWNDTEVKVTATCIRVPVMRAHAESVNLQFENPLDENTAREILKKAPGVYIIDDRASNTFPTPLDVSNKDDVAVGRIRRDVSQDGNFGLDIFVCGDQIRKGAALNAVQIAEMLL

SEQ ID NO: 14726 - protein, 375 aa, Phaseolus vulgaris
MASLSVSRHSHLLSGFLPARPKPTSGPTRVRMSLRDDGPAIAVVGVTGAVGQEFLSVLSDRDFPYRSIKMLASQRSAGRRIVFEDMDYVVEELTADSFDGVDIALFSAGGSISKKFGPAAVDRGTVVVDNSSAFRMDEKVPLVIPEVNPEAMQHIKAGTGKGALIANPNCSTIICLMAATPLHRRAKVLRMVVSTYQAASGAGAAAMEELELQTREVLEGKPPTCKIFNRQYAFNIFSHNAPVLSNGYNEEEMKMVKETRKIWNDKDVKVTATCIRVPVMRAHAESVNLQFENPLDENTARDILKNAPGVVVIDDREANSFPTPLEVSNKDDVAVGRIRQDLSQDGNQGLDIFICGDQIRKGAALNAIQIAEMLL

SEQ ID NO: 14727 - protein, 386 aa, Lippia dulcis
MKLPTLSSHHHHHHLANPFLHKPTACAVSRSTRVSNGRFAVRMSLKEDGPSVAIVGVTGAVGQEFLSVLSDRDFPYRSLKLLASKRSSGKTLNYEDRSYTVEELTENSFDDVDIALFSAGGSISKKFGPIAVEKGTIVVDNSSAFRMDEGIPLVIPEVNPEAMEGIKIKSGKGALIANPNCSTIICLMAATPLHRRAKVTRMVVSTYQAASGAGAAAMAELELQTREVLEGKEPTCEIFKQQYAFNLFSHNAPIVSNGYNEEEMKLVKETRKIWSDKNVKVTATCIRVPVMRAHAESVNLQFETPLDEDTAREILKNAPGVVVIDDRSANRFPTPLQVSNKDDVAVGRIRQDVSQGGNYGLDIFVCGDQIRKGAALNAIQIAEMLL

SEQ ID NO: 14728 - protein, 376 aa, Cajanus cajan
MASLSVSRHNHLFSGPLPARFRPTLSGPTRIRMSLRENGPSIAVVGVTGAVGQEFLSVLSDRDFPYRSIKMLASKRSAGRRITFEGRNHVVEELTAESFDGVDIALFSAGGSISREFGPVAVDRGTVVVDNSSAFRMDEKVPLVIPEVNPEAMHNIKAGMGKGALIANPNCSTIICLMAATPLHRRAKVLRMVVSTYQAASGAGAAAMEELELQTREVLEGKQPTCKIFNQQYAFNLFSHNASVLSNGYNEEEMKMVKETRKIWNDNDVKVTATCIRVPVMRAHAESVNLQFERPLDEDTARDILKNAPGVVVIDDRQSNHFPTPLEVSNKDDVAVGRIRRDLSQDGNKGLDIFVCGDQIRKGAALNAIQIAEMLL

SEQ ID NO: 14729 - protein, 344 aa, Mimulus guttatus
MSLKEDGPSVAIVGVTGAVGQEFLSVLTDRDFPYRSLKLLASKRSAGKTLTYENRDYTVEELTESSFDDVDIALFSAGGSISKKFGPIAVDKGTIVVDNSSAFRMDDGIPLVIPEVNPEAMAGIKLNSGKGALIANPNCSTIICLMAATPLHRRAKVTRMVVSTYQAASGAGAAAMEELELQTREVLEGKKPTCQIFNQQYAFNLFSHNAPVLSNGYNEEEMKLVKETRKIWNDKNVKVTATCIRVPVMRAHAESVNLQFETPLDEAAAREILSKAPGVVVIDDRAANKFPTPLEVSNKDDVAVGRIRQDVSQDGNYGLDIFVCGDQIRKGAALNAIQIAELLL

SEQ ID NO: 14730 - protein, 383 aa, Lactuca sativa
MQSAAVAHRHFLDGGAAASSFPLSHFKPTPSTASPFSVRMSLREDAPSLAVVGVTGAVGQEFLSVLSDRSFPYRSIKMLASKRSAGKKYTFEDNEYVVEELTADSFKDVDIALFSAGGSISKEFGPIAANCGSVVVDNSSAFRMDDGVPLVIPEVNPDAMAHIKLGSGKGALIANPNCSTIICLMAATPLHRRAKVLRMVVSTYQAASGAGAAAMEELELQTREVLEGKRPTCKIFKQQYAFNLFSHNAPVLPNGYNEEEMKLVKETRKIWNDKDIKVTATCIRVPVMRAHAESVNLQFASPLDENEARDILKKAPGVVVIDDRASNHFPTPLEVSNKDDVAVGRIRRDESQDGNYGLDIFVCGDQIRKGAALNAVQIAELLL

SEQ ID NO: 14731 - protein, 379 aa, Medicago truncatula
MASSLSLLRQNTFLSATLPTTRPKPKYASAPGRVRMSLQENAPTIAVVGVTGAVGQEFLSVLSDRDFPYSSIKMLASKRSAGRRMTFEDKEYVVEELTAESFDGVDIALFSAGGSISKEFGPIAVNRGTIVVDNSSAFRMDENVPLVIPEVNPEAMEKIKVGMGKGALIANPNCSTIICLMAATPLHRHAKVLRMVVSTYQAASGAGAAAMEELELQTREVLEGKPPTCKIFNRQYAFNLFSHNASVLSNGYNEEEMKLVKETRKIWNDKDVKVTATCIRVPVMRAHAESVNLQFERPLDEDTARDILKNSPGVVVIDDRESNNFPTPLEVSNKDDVAVGRIRRDLSQDGNQGLDIFICGDQIRKGAALNAIQIAELLL

SEQ ID NO: 14732 - protein, 375 aa, Eutrema halophilum
MATLTHHTPQTHFLSRLPLRAKPRVFSTRVKMSLQESGPSLAVVGVTGAVGQEFLSVLSDRDFPYSSVKMLASKRSAGKHVAFDGREYTVEELTAESFDGVDIALFSAGGSISKEFGPLAAEKGTIVVDNSSAFRMVEGVPLVIPEVNPEAMKGIKVGMGKGALIANPNCSTIICLMAVTPLHHHAKVKRMVVSTYQAASGAGAAAMEELVQQTREVLAGRPPTCNIFGQQYAFNLFSHNAPITDNGYNEEEMKLVKETRKIWNDTEVKVTATCIRVPVMRAHAESVNLQFENPLDENTARELLKKAPGVYIIDDRSSNTFPTPLDVSNKDDVAVGRIRRDVSQDGNFGLDIFVCGDQIRKGAALNAVQIAEMLL

SEQ ID NO: 14733 - protein, 384 aa, Panax ginseng
MNSAAFTRHQFLGGGAIFSLHQPKPTISTTTTSSSHFTVRMSLREDGPSLAVAGVTGAVGQEFLSVLSDRSFPYRSIKMLASKRSAGKKFTFEDNEYVVEELTPDSFSGVDIALFSAGGSISKQFGPIAADGGTIVVDNSSAFRMDENVPLVIPEVNPDAMSGIKLGSGKGALIANPNCSTIICLMAVTPLHRRAKVVRMIVSTYQAASGAGAAAMEELEQQTREVLYGKQPTCKIFKRQYAFNLFSHNAPVLSNGYNEEEMKLVKETRKIWNDTSVKVTATCIRVPVMRAHAESVNLQFEKPLDEDTARDILKNASGVVVIDERASNHFPTPLEVSNKDDVAVGRIRRDVSQDGNYGLNIFVCGDQIRKGAALNAVRIAEMLL

SEQ ID NO: 14734 - protein, 375 aa, Lupinus angustifolius
MASLSLQHNTHHFLSRALPTQPKPKPTFFVRMSLKETGPSIAVVGVTGAVGQEFLSVLSDRDFPYRSIKMLASKRSAGRRITFEDNDYVVEELTPESFAGVDIALFSAGGSISREFGPIAVERGTIVVDNSSAFRMDEKVPLVIPEVNPEAMANIKVGKGKGALIANPNCSTIICLMAATPLHRRAKVLRMVVSTYQAASGAGAAAMDELELQTREVLEGKPPTCKIFNQQYAFNIFSHNASVLPNGYNEEEMKMVKETRKIWNDKDVKVTATCIRVPVMRAHAESVNLQFESPLDEDTARDILKNAPGVVVIDDRESNHFPTPLEVSNKDDVAVGRIRQDLSQDGNQGLDIFICGDQIRKGAALNAIQIAEMLL

SEQ ID NO: 14735 - protein, 376 aa, Glycine max
MASLSVLRHNHLFSGPLPARPKPTSSSSSRIRMSLRENGPSIAVVGVTGAVGQEFLSVLSDRDFPYRSIHMLASKRSAGRRITFEDRDYVVQELTPESFDGVDIALFSAGGSISKHFGPIAVNRGTVVVDNSSAFRMDEKVPLVIPEVNPEAMQNIKAGTGKGALIANPNCSTIICLMAATPLHRRAKVLRMVVSTYQAASGAGAAAMEELELQTREVLEGKPPTCKIFNRQYAFNLFSHNASVLSKGFNEEEMKMVKETRKIWNDKDVKVTATCIRVPIMRAHAESVNLQFERPLDEDTARDILKNAPGVVVIDDRESNHFPTPLEVSNKDDVAVGRIRQDLSQDGNQGLDIFVCGDQIRKGAALNAIQIAEMLL

SEQ ID NO: 14736 - protein, 375 aa, Eutrema parvulum
MATLTHQTPHTHFLSRLPLRAKPRAFSARVKMSLQESAPSLAVVGVTGAVGQEFLSVLSDRDFPYSSVKMLASKRSAGKRVAFDGREYTVEELTAESFNGVDIALFSAGGSISKEFGPLAAEKGTIVVDNSSAFRMVEGVPLVIPEVNPEAMKGIKVGTGKGALIANPNCSTIICLMAVTPLHHHAKVKRMVVSTYQAASGAGAAAMEELVQQTREVLAGRPPTCNIFGQQYAFNLFSHNAPITENGYNEEEMKLVKETRKIWNDTEVKITATCIRVPVMRAHAESVNIQFENPLDENTARELLKKAPGVYIIDDRSSNTFPTPLDVSNKDDVAVGRIRRDVSQDGDYGLDIFVCGDQIRKGAALNAVQIAEMLL

SEQ ID NO: 14737 - protein, 374 aa, Citrullus lanatus
MAALSSSRTSFFFSTASPHPKPRRISKVVRMAYQENGPSLAVVGVTGAVGQEFLSVLSDRDFPYRSIKMLASKRSAGKSVSFHGEEHIVEELTADSFDGVDIALFSAGGSISKHFGPLAVEKGTIVVDNSSAFRMDENVPLVIPEVNPEAMKGIKVGKGKGALIANPNCSTIICLMAVTPLHRHAKVLRMVVSTYQAASGAGAAAMEELVQQTREVLEGKPPTCNIFRDQYAFNLFSHNASVLSNGYNEEEMKLVKETRKIWSDANVKVTATCIRVPVMRAHAESVNLQFENPLDENAAREILKNAPGVVIIDDRAANQFPTPLKVSNKDDIAVGRIRQDVSLDGNKGLDIFICGDQIRKGAALNAVQIAELLL

SEQ ID NO: 14738 - protein, 244 aa, Beta vulgaris
MTSAMNFTVKPHSPFLSTTIRHSQHSSFSLLSFPRSSPSSIRMSLRDDGPSIAVVGVTGAVGQEFLSVLSDRDFPYRSIKLLASKRSAGKQMSFEGKNYVVEELDANSFDGVDIALFSAGGSISKQFGPLAVEKGTIVVDNSSAFRMVEDVPLVIPEVNPEAMAHIKVSNRKGALIANPNCSTIICLMAATPLHRRAKVTRMVVSTYQAASGAGAAAMEELEFQTRGFWKASLQLVTFLISSSF

SEQ ID NO: 14739 - protein, 291 aa, Solanum phureja
MFFQTWVLKVSIHCPGCKRKVKKVLQSIEGVYTTDIDPQQQKVIVTGNVEAETLIKKLIRNGRNAELWPEPKPILREKKPKKTENSDDDDDDHEDDEHNNNEKPAEHGPQRHGVRFGGVETFTMDVKEVRPDERPPENIAVVERFPAPEQKAAGGAKKKKKKKKKKSTGNNNANPNASAGSNGAPPSSESDVAKMGPNQMMDQTNLGHSFQHPYPNPYDQHPHASYHVPQQHQSYVVSYNAAHPMVSSAPPYYYVPSSPYMQSDIYSKQQSTPLDSFEILSDENPHACYIM

SEQ ID NO: 14740 - protein, 168 aa, Solanum tuberosum
MDVKEVRPDERPPENIAVVERFPAPEQKAAGGAKKKKKKKKKKSTGNNNANPNASAGSNGAPPSSESDVAKMGPNQMMDQANLGHSFQHPYPNPYDQHPHASYHVPQQHQGYVVSYNAAHPMVSSAPPYYYVPSSPYMQSDIYSKQQCTPLDSFEILSDENPHACYIM

SEQ ID NO: 14741 - protein, 1086 aa, Solanum phureja
MAKKQNNSSRFSTNLTPSPKRTKPISSPSPNPDALALSIPFPQNEEPVPLIVFFPSVRRRSSRFTTNKFSTSATTATEFMRKNRNSISPEKTVFLLPSPPTLAGKTPPAEGTRRSPRLVSLSSRTTTAEDKGKKVNSRKSEGIIKQVELSRKRKSASSKMDEKSRKSPRFDSDSSNGVQLELLALPEKSACGAIAAGGRTGTKRELLALMMTPAANGSASKKRGSRGSDSVNAGNNSRGSRRKDPVFAESPGTSEKITAESNSVGAKTLRSRKIQGSVNYNESKGPEMKRIKNSAEKSVRKQKSNACFIGEPIDTEEAQEKWQWRYELKNRKMQRQGWKLNSGEEDEIILNVECHYAQAKVAGFIFNIGDCAFVKGEGKKKHIGRILEFFKTTEGEDYFRVQWFFRAEDTVLQGAASFHDRKRVFYSTLENDNLLDCIVSKVNVVELPTRLDLNKKDVPPAHFYYDMEYCVDYSTFRTLHNVKSSVSPSLVDASYKPITTYPLEVSPSCEPMKVELSLLDLYAGCGGMSMGLCLGTKLSGVNLVTKWAVDFNSAACDSLKLNHPQTHVRNEGVENFLELLKRWEKLIKSYGCSDIKTSSNGELDDRDEGENNDDSQSGSNASSGEYEVLRLVDICYGDPNDEGKSGLHFKVRWKGYSPSEDTWEPIANLENCGDSIKDFVRRGQQLKILPLPGDVDMICGGPPCQGISGYNRHRNTDDPLSDEKNRQIIIFMDVVEFLRPKYVLMENVADILRFDKASLGRYALSRLVHMRYQARLGTMAAGCYGLPQFRLRVFFWGALPSERLPPFPLPSHDVIVKYWPSPEFERNTVAYEEGQPRDLEEALVLRDAISDMPAVTWHETREERPYEIPPETEFQKYMRLSKHEIMSCSSTGVKETKEPVLSDHRPCQLNEDDYLRVCLVPRRKGANFRDLPGVIVGGDNVARRDTKDPKVLPNGKPMVPDCAFNFENGKSKRPFARLWWDETVATLVTFPNHRAQAILHPEQDRVLTIREYARLQGFPDFYRFTGTLKERYCQVGNAVAVPVGRALGYALGLAYQRLAGNEPLIKLPSNFSFLTPPIDDIVVLQT

SEQ ID NO: 14742 - protein, 337 aa, Solanum tuberosum
METKVISSGIHHSTLPQSYIRPESDRPRLSEVVDCENVPIIDLGCGDQAQIIRLIGEACQTYGFFQVINHGVPKEVVEKMLGVAGEFFNLPVEEKLKLYSDDPSKTMRLSTSFNVKKETVHNWRDYLRLHCHPLEKYAPEWPSNPSSFRDIVSRYCTEVRQLGFRLEEAIAESLGLEKECIKDVLGEQGQHMAINFYPPCPQPELTYGLPAHTDPNSLTILLQDLQVSGLQVLKDGKWLAVKPQPDAFVINLGDQLQAVSNGKYKSVWHRAIVNSDQARMSVASFLCPCDSAKISAPKLLTEDGSPVIYQDFTYAEYYKKFWSRNLDQEHCLELFKN

SEQ ID NO: 14743 - protein, 337 aa, Solanum phureja
METKVISSGIHHSTLPQSYIRPESDRPRLSDVVDCENVPIIDLGCGDQAQIIRLIGEACQTYGFFQVINHGVPKEVVEKMLGVAGEFFNLPVEEKLKLYSDDPSKTMRLSTSFNVKKETVHNWRDYLRLHCHPLEKYAPEWPSNPSSFRDIVSRYCTEVRQLGFRLEEAIAESLGLEKECIKDVLGEQGQHMAINFYPPCPQPELTYGLPAHTDPNSLTILLQDLQVSGLQVLKDGKWLAVKPQPDAFVINLGDQLQAVSNGKYKSVWHRAIVNSDQARMSVASFLCPCDSAKISAPKLLTEDGSPVIYQDFTYAEYYKKFWSRNLDQEHCLELFKN

SEQ ID NO: 14744 - protein, 257 aa, Nicotiana tabacum
MGCGDRNHIIRQIGEACHLYGFFQVINHGVPTNLVEEMLEIAREFFNLPVEEKLKLYSDDPSKTMRLSTSFNVKKETVHNWRDYLRLHCYPLEKYAPEWPSNPASFREIVSRYCTEVRQLGFRLQEAIAESLGLEKVCIKDVLGEQGQHMAINFYPPCPQPELTYGLPAHTDPNALTILLQDLQVAGLQVLKDGKWLAVKPQPDAFVINLGDQLQAVSNGRYKSVWHRAIVNSDKAGCQWLRSFVRAIARKSVLQSS

SEQ ID NO: 14745 - protein, 337 aa, Nicotiana benthamiana
MEAKVLSSGIRHSTIPQSYIRPQSDRPRLSEVADCENVPVVDIGCGDRNLIVHQIGEACRLYGFFQVINHGVPKNLIDEMLEIAGEFFRLPVEEKLKLYSDDPSKTMRLSTSFNVKKEKVHNWRDYLRLHCYPLENYAPEWPSNPSSFREIVSRYCMEVRQLGFRLQEAIAESLGLEKECIKDVLGEQGQHMAINFYPPCPQPELTYGLPAHTDPNALTILLQDLEVAGLQVLKDGEWLAVKPQPDAFVINLGDQLQAVSNGRYKSVWHRAIVNSDKARLSVASFLCPCDSAKISAPKLLTEDGSPVIYQDFTYAEYYKKFWSRNLDQEHCLELFKN

SEQ ID NO: 14746 - protein, 342 aa, Solanum phureja
METTSVLSGGFNHSTLPESYVRPESQRPRMSEVVDRDDLVPVIDMSCTDRNVIVHQIGEACRLYGFFQVINHGVSKKVMDEMLGVAHEFFKLPVEEKMKLYSDDPSKTMRLSTSFNVKKETVHNWRDYLRLHCYPLDKYAPEWPSNPPSFREIVSKYCMEVRQVGYRLEEAISESLGLEKDCIKNVLGEQGQHMAINFYPPCPQPELTYGLPAHTDPNAITILLQDLQVAGLQVLKDGEWLSIKPQPDAFVINLGDQLEALSNGKYKSIWHRAIVNSDKARMSVASFLCPNDCSIISAPKTLIEDGSSAIYRDFTYTEYYDKFWSRNLDQEYCLELFKNDGT

SEQ ID NO: 14747 - protein, 342 aa, Solanum lycopersicum
MTTTSVLSSGFNHSTLPQSYVRPESQRPCMSEVVDSDDLVPVIDMSCTDRNVIVHQIGEACRLYGFFQVINHGVSKKAMDEMLGVSHEFFKLPVEEKMKLYSDDPSKTMRLSTSFNVKKEAVHNWRDYLRLHCYPLDKYAPEWPSNPPSFREIVSKYCMEVRELGYRLEEAISESLGLEKDCIKNVLGEQGQHMAINFYPQCPQPELTYGLPAHTDPNAITILLQDLQVAGLQVLKDGKWLSIKPHPNAFVINLGDQLEALSNGKYKSIWHRAIVNSDKARMSVASFLCPNDCSIISAPKTLTEDGSSAIYRHFTYAEYYEKFWSRNLDQEYCLELFKNDGT

SEQ ID NO: 14748 - protein, 336 aa, Vinca minor
MYTKVLSSGVHISLPESYVRPESERPKLSEVSDCENVPVIDLGSGDRSLIVQQIGEACRDYGFFQVINHGVPKEVVEKMQNVANEFFSLPVEEKLKLYSEDPSKTMRLSTSFNVKKETVHNWRDYLRLHCHPLDQYVPEWPSNPPLFKDIVRNYCMEVRELGFRLEELISESLGLNKNCLKDVVGEQGQHMAINYYPPCPEPELTYGLPGHTDPNTLTILLQDLGVAGLQVLKDGNWLAVKPYPDAFVVNIGDQLQALSNGKYKSVWHRAVVNADKPRLSVASFLCPCDGALLSAPKPLTDDGSPVVYRDFTYAEYYSKFWSRNLDQEHCLELFKN

SEQ ID NO: 14749 - protein, 2066 aa, Solanum phureja
MSHRGACGCETNTGDGAGILVGLPHDFYKEVASEAGFELPPPGQYAVGMFFLPTSDSRREQSKIVFTKVAESLGHTVLGWRPVPTDNSGLGKSALQTEPIIEQVFLTPTPRSKVDFERQMYILRRVAMVAIRAALNLQHGGVKDFYICSLSSRTVVYKGQLKPNQLKEYYFADLGNERFTSYMALVHSRFSTNTFPSWDRAQPMRVLGHNGEINTLRGNVNWMRAREGLLKCKELGLSKTEMKKLLPIVDASSSDSGAFDGVLELLLRAGRSLPEAVMMMIPEAWQNDKNMDPSRKALYEYFSALMEPWDGPALMSFTDGRYLGATLDRNGLRPGRFYVTYSGRVIMASEVGVVDIPPEDVSRKGRLNPGMMLLVDFENHVVVDDDALKKQYSLARPYGQWLKKQKIELKDIVESVNYSYRVPPPIAGVLPAVSDEDSMENMGLHGLLAPLKAFGYTIEALEMLLLPMAKDGVEALGSMGNDAPLAVMSNREKLTFEYFKQMFAQVTNPPIDPIREKIVTSMQCMVGPEGDLTETTEEQCHRLSLKGPLLSIEEMEAVKKMNYRGWRSKVLDITYSRDRGTKGLEETLDRICSEAHDAIQEGYTAIVLSDRGFSPKRVAVSSLLAIGAVHHHLVKKLERTRVALIVESAEPREVHHFCTLVGFGADAICPYLAVEAIWRLQVDGKIPPKSTGEFHSKDELVKKYFKASHYGMMKVLAKMGISTLASYKGAQIFEAVGLSSEVMERCFNGTPSRVEGATFDALAKDALNLHGLAFPSRALAPGSAEAVALPNPGDYHWRKGGEIHLNDPFAIAKLQEAAQSNSVAAYKEYSKRVQELNRQCNLRGLLKFKEGEVKVPLEEVEPASEIVKRFCTGAMSYGSISLEAHATLAMAMNKIGGKSNTGEGGEQPSRMEPLPNGSKNPKRSAIKQVASGRFGVSSYYLTNADELQIKMAQGAKPGEGGELPGHKVIGDIAVTRNSTAGVGLISPPPHHDIYSIEDLAQLIHDLKNANPGARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPILREKFAGEPEHVINFFFMLAEELREIMSQLGFRTLIEMVGRSDMLEMDNDLVKNNDKLKNIDLSLLLRPAADIRPEAAQYCIQKQDHGLDLALDNNLIALSKAALEKSLPVYIETPICNVNRAVGTMLSHEVTKRYHLAGLPADTIHIKLSGSAGQSLGAFLCPGITLELEGDSNDYVGKGLSGGKIVVYPPKGSKFDPKENIVIGNVALYGATSGEAYFNGMAAERFCVRNSGAKAVVEGVGDHGCEYMTGGTVVVLGKTGRNFAAGMSGGVAYVLDLHSTFHSRCNSELVDLDKVEEEEDVMTLKMMIQQHQRNTNSQLAKEVLADFDNLLPRFIKVFPRDYKRVLASMKKEEAYEAAKERAIKEAEEQEEEELKEKDAFEELKKLAAASKDESSQVEEENTLKRPTQVAEAVKHRGFVAYERQGVSYRDPNVRMKDWKEVMEESKPGPLLTTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPSERTGRRVAIVGSGPSGLAAADQLNRLGHTVTVFERADRIGGLMMYGVPNMKTDKIDVVQRRVDLMEKEGVKFVVNANIGNDPAYSLDSLREDHDAIILAVGATKPRDLPVPGRDLSGVHFAMEFLHANTKSLLDSNLQDGKYISAKGKKVVVIGGGDTGTDCIGTSIRHGCSSVVNLELLPQPPNTRAPGNPWPQWPRVFRVDYGHQEASAKFGKDPRSYEVLTKRFIGDENGNVKGLEVIRVQWEKDASGRFQFKEVEGSEEIIGADLVMLAMGFLGPESTIADKLGLEKDNRSNFKADYGRFSTSVEGVFAAGDCRRGQSLVVWAISEGRQAAAQVDKFLMKDDEDSSADAASQQESVKKQPTVVT

SEQ ID NO: 14750 - protein, 2214 aa, Amsonia hubrichtii
MSVASGSSLIQAKNNGVGLPSVTKPFVNHQLNVVRLSRAGGVRASKRKSRCGWQTSKFLGARLPRALGSESLHRWQTDGPGQAPKLRVVKVHSALSQVPEKPLGLYDPSFDKDSCGVGFVAELSGESSRKTVTDAIEMLVRMAHRGACGCETNTGDGAGILVALPHDFYKEVTKDVGFELPPPGEYAVGMFFLPTSESRREQSKIVFTKVAESLGHTVLGWRPVPTDNSGLGQSALQTEPVIEQVFLTPTPRSKADFEQQMYILRRVSMVAIRAALNLQHGGVRDFYICSLSSRTVVYKGQLKPVQLKEYYFADLGNERFTSYMALIHSRFSTNTFPSWDRAQPMRVLGHNGEINTLRGNINWMKAREGLLKCKALGLSKTEMKKLLPIVDASSSDSGAFDGVLELLVRAGRSLPEAIMMMIPEAWQNDKNMDPDRKALYEYFSALMEPWDGPALISFTDGRYLGATLDRNGLRPGRFYVTHSGRVIMASEVGVVDIPPEDVSRKGRLNPGMMLLVDFENHVVVDDDALKQQYSLARPYGEWLKRQKIELKDIVESIQDSGRVPPPIAGVVAASDDDENLENLGLHGLLAPLKAFGYTVEALEMLMLPMAKDGVEALGSMGNDAPLAVMSNREKLTFEYFKQMFAQVTNPPIDPIREKIVTSTECMIGPEGDLTETTEEQCHRLSLKGPLLSIEEMEAIKKVNYRGWRSKVLDITYSKERGRKGLEETLDRICSEARDAIKEGYTSLVLSDRAFSPKRVAVSSLLAVGAVHHHLVKKLERTRVALIVESAEPREVHHFCTLVGFGADAICPYLAVEAIWRLQIDGKIPPKATGEFHSKDELVKKYFKASHYGMMKVLAKMGISTLASYKGAQIFEAVGLSSEVMERCFKGTPSRVEGATFEALAHDALTLHEMAFPSRVLPAGSAEAVALPNPGDYHWRKGGEIHLNDPLAIAKLQEAAKSNSVAAYKEYSKRIQELNKSCNLRGLLKFKDGEVKVPLEEVEPASEIVKRFCTGAMSYGSISLEAHTTLAIAMNKLGGKSNTGEGGEQPSRMEPLPDGSMNPKRSAIKQVASGRFGVSSYYLTNADELQIKMAQGAKPGEGGELPGHKVVGDIAITRNSTAGVGLISPPPHHDIYSIEDLAQLIHDLKNANPGARISVKLVSEAGVGVIASGVVKGHADHVLISGHDGGTGASRWTGIKSAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMLAEEVREIMSQLGFRSIKEMVGRSDMLELDEDLVKDNEKLKNIDLSLLLRPAADIRPDAAQYCIQKQDHGLEMALDRKLIELSKSALEKSIPVYIETAICNVNRAVGTMLSHEVTKRHHMIGLPADAIHIKFNGSAGQSFGAFVCPGITLELEGDSNDYVGKGLSGGKIIVYPPKGSKFDPKENIVIGNVALYGAIAGEAYFNGMAAERFCVRNSGAKAVVEGVGDHGCEYMTGGTVVVLGKTGRNFAAGMSGGIAYVLDVDSKFRSRCNSELVDLDKVEEEDDILTLRMMIQQHQRHTNSQLAKEVLADFDSLLPKFIKVFPRDYKRVLASMKEKENDKMVAERAVKEVEEQEAAELMEKDAFEELKKLAASSSNEEANEVEESKPNKRPTRVADAVKHRGFVAYERESISYRDPDTRISDWKEVMVEGKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFDEGWMVPRPPPKRTGKRVAVVGSGPAGLAAADQLNKMGHSVTVFERSDRIGGLMMYGVPNMKADKIDIVQRRVDLMEKEGVNFVVNANVGNDPSYALDQLREEHDAIVLAVGSTKPRDLPVPGRDLSGVHFAMEFLHANTKSLLDSNLQDGNYISAKGKKVVVIGGGDTGTDCIGTSIRHGCSSIVNLELLPQPPQTRAPGNPWPQWPRIFRVDYGHQEAAAKFGKDPRSYEVLTKRFVGDENGVVKGLEVVRVKWEKDASGKFQFKEVEGSEEMIEADLVFLAMGFLGPESTIADKLGLEKDNRSNFKAEYGRFSTSVEGVFAAGDCRRGQSLVVWAISEGRQAAAQVDKYLMKDDDTDIELNSRKQEEYTKRQQDSNKHTVMT

SEQ ID NO: 14751 - protein, 2215 aa, Sesamum indicum
MSTVSGSGIQRGCGGGLVKPAACAPSHQLNAVAALSRRVRVSREFTSKQRRVNLENRFVCGTRLRGVAAPDLGSGSERFHLWQTDGPGRAPKLRVVVKNALSQVPEKPLGLYDPSFDKDSCGVGFVAELSGETSRKTVTDAVEMLVRMTHRGACGCETNTGDGAGILVGLPHDFYREAAKDAGLELPPPGEYAVGMFFLPTSDSRREQSKVVFTKVAESLGHTVLGWRLVPTDNSGLGKSALQTEPIIEQVFLTATPRSKADFEQQMYILRRVSMVAIRAALNLQHGGVRDFYICSLSSRTIVYKGQLKPDQLKEYYYADLGNERFTSYMALVHSRFSTNTFPSWDRAQPMRVLGHNGEINTLRGNVNWMRAREGLLKCKELGLSKTEMKKLLPIVDASSSDSGAFDGVLELLVRAGRSLPEAVMMMIPEAWQNDKNMDPNRKALYEYFSALMEPWDGPALISFTDGRYLGATLDRNGLRPGRFYITHSGRVIMASEVGVVDIPPEDVSRKGRLNPGMMLLVDFEKHIVVDDEALKQQYSLARPYGEWLKRQKFQLKDIVESVQESDRSPPPVAGVLPASPEDENMESMGIHGLLSPLKAFGYTVESLEMLLLPMAKDGIEALGSMGNDAPLAVMSNREKLTFEYFKQMFAQVTNPPIDPIREKIVTSMECMIGPEGDLTETTEEQCHRLSLKGPLLSIEEMEAMKKMNYRGWRSKVLDITYSKGRGRKGLEETLDRICNEAHNAIKEGYTTLVLSDRAFSSKRVAVSSLLAIGAVHHHLVKKLERTRVALIVESAEPREVHHFCTLVGFGADAICPYLAIEAIWRLQVDGKIPPKATGEFHTKEELVKKYFKASNYGMMKVLAKMGISTLASYKGAQIFEAVGLSSEVMERCFSGTPSRVEGATFEALAHDALQLHELAFPTRATPPGSAEAVALPNPGEYHWRKGGEIHLNDPLAIAKLQEAARSNSVAAYKEYSKRVQELNKSCNLRGLLKFKEAEVKVPLEEVEPASEIVKRFCTGAMSYGSISLEAHTTLAIAMNKIGGKSNTGEGGEQPSRMEPLPDGSRNPKRSSIKQVASGRFGVSSYYLTNADELQIKMAQGAKPGEGGELPGHKVIGDIAVTRNSTAGVGLISPPPHHDIYSIEDLAQLIHDLKNANPGARISVKLVSEAGVGVIASGVVKGHADHVLISGHDGGTGAARWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTLNEMVGRSDMLELDKDLVKNNEKLKNIDLSLLLRPAADIRPDAAQYCVQKQDHGLDMALDNKLISLAKPALDRSLPVYIESPICNVNRAVGTMLSHEVTKRYHLAGLPSDTIHIKLNGSAGQSLGAFLCPGITLELEGDSNDYVGKGLSGGRIIVYPPQGSKFDPKENIVIGNVALYGATTGEAYFNGMAAERFAVRNSGAKAVVEGVGDHGCEYMTGGTVVVLGKTGRNFAAGMSGGIAYVLDIDSAFRSRCNLELVDLDPVEDDDDILTLRMMIQQHQRHTGSQLAKDVLAEFDSLLPKFIKVFPRDYKRILASKKAEEISKVAAENAAKEDEVQEEAELMEKDAFEELKKLAATSANAKPSQVEQQKSLKRPTRVPDAIKHRGFVAYEREGISYRDPNVRVNDWNEVMEELKPGPLLKTQSARCMDCGTPFCHQENSGCPLGNKIPEFNELVYQNRWREALDRLLETNNFPEFTGRVCPAPCEGSCVLGIIENPVSIKSIECSIIDKAFEEGWMVPRPPLKRTGKRVAIVGSGPSGLAAADQLNKMGHSVTVFERADRIGGLMMYGVPNMKADKIDIVQRRVDLMEKEGVNFVVNANVGKDPSYSLDRLREEHDAIVLAVGATKPRDLPVPGRDLSGVHFAMEFLHANTKSLLDSKLQDGNYISAKGKKVVVIGGGDTGTDCIGTSIRHGCSSVVNLELLPEPPRTRAPGNPWPQWPRVFRVDYGHQEAATKFGRDPRSYQVLTKRFIGDENGVVKGLEVVHVNWEKDASGRFQFKEVEGSEEIIGADLVLLAMGFLGPEETLAEKLGLERDNRSNFKAEYGRFSTNVEGVFAAGDCRRGQSLVVWAISEGRQAAAQVDKYLSDATVASEGDEEFVKRQQDSNRQRVMT

SEQ ID NO: 14752 - protein, 2217 aa, Panax ginseng
MSVASYSVIQFQAGNNSSSSSLVLPLAAKLKPLLNPQLNVLNRAGVKAKAKTKKPSCFVLENRFYRTRLRGGSGPERHHLWQSDGPGRAPKLRVVVRSSMSQVPEKPLGLYDPSFDKDSCGVGFVAELSGQSSRKTITDAIEMLVRMSHRGACGCETNTGDGAGILVALPHDFYKEVANDVGFELPPPGEYAVGMFFLPTSENRRQQSKIVFTKVAESLGHTVLGWRPVPTDNSGLGRSALQTEPVIEQVFLTPTPRSKADFEQQMYILRRVSMVAIRAALNLQHGGVKDFYICSLSSRTIVYKGQLKPNQLKEYYADLGNQRFTSYMALIHSRFSTNTFPSWDRAQPMRVLGHNGEINTLRGNVNWMKAREGLLKCKELHLSKNELKKLLPIVDASSSDSGAFDGVLELLVRAGRSLPEAMMMMIPEAWQNDKNMDPHRKALYEYFSALMEPWDGPALISFTDGRYLGATLDRNGLRPGRFYITHSGRVIMASEVGVVDIPPEDVSRKGRLNPGMMLLVDFENHVVVDDEALKHQYSLARPYGQWLERQKITLKNIVESVHESDRVSPPISGVLQASTDDDNMENMGLCGLLSPLKAFGYTVESLEMLLLPMAKDGVEALGSMGNDAPLAVMSSREKLTFEYFKQMFAQVTNPPIDPIREKIVTSMECMIGPEADLTETTEEQCHRLSLKGPLLSIDEMQAIKKMNYRGWRSKVVDITYSKERGSKGLEETLDRICLEAHNAIKEGYTTLVLSDRAFSSNRVPVSSLLAVGAVHHHLVKKLERTRIALIVESAEPREVHHFCTLVGFGADGICPYLAVEAIWRLQVDGKIPPKSNGEFHSKDDLVKKYFKASHYGMMKVLAKMGISTLASYKGAQIFEAVGLSSEVMERCFAGTPSRVEGATFEALAHDALHLHELAFPTRALPPKSAEAVALPNPGDYHWRKGGEVHLNDPLAIAKLQEAARGNSVAAYKEYSKRIQELNKTCNLRGLLKFKEAAVKIPLEEVEAASEIVKRFCTGAMSYGSISLEAHTTLAIAMNKIGGKSNTGEGGENPSRLEPLSDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPAARVSVKLVSEAGVGVIASGVVKGHADHILISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGVRTINEMVGRSDMLEMDKELTKNNEKLKNIDLSLLLRPSADIRPEAAQYCVQKQDHGLDMALDKNLIALSRPALVNGLPVYMETPICNINRAVGTMLSHEVTKRYHMVGLPADTIHIKLNGSAGQSLGAFLCPGIMLELEGDSNDYVGKGLSGGKIVVYPPKGSQFDPKENIVIGNVALYGATNGEAYFNGMAAERFCVRNSGAKAVVEGVGDHGCEYMTGGTVVVLGKTGRNFAAGMSGGIAYIFDVDSKFRSRCNPELVDLDKVEEEDDIMTLRMMIQQHQRHTNSQLAKELLADFDNLLSKFIKVFPRDYKRILVSLKQEETAKKAVDRAAKEAEEQEEAELFEKDAFEELKKMSDASMKEKASEAGIAESLKRPTQVTDAVKHRGFVAYERKGVSYRDPNVRMNDWKEVMEESKPGPLLKTQSARCMDCGTPFCHQENSGCPLGNKIPEFNELVYQNRWREALNRLLETNNFPEFTGRVCPAPCEGSCVLGIIENPVSIKSIECSIIDKAFEEGWMVPRPPLERSGKRVAIVGSGPSGLAAADQLNRMGHSVTVFERADRIGGLMMYGVPNMKTDKIDVVQRRVDLMEKEGVTFVVNASVGKDPSYSLEHLREENDAIILAVGATKPRDLPVPGRDLSGVHFAMEFLHANTKSLLDSNLQDGNYISAKGKKVVVIGGGDTGTDCIGTSIRHGCSSIINLELLPEPPRTRAPGNPWPQWPRIFRVDYGHEEAASKFGKDPRSYEVLTKRFIGDENGTVKGLELVRVQWEKDASGKFQFKEVEGSEEIIEADLVLLAMGFLGPESKIADKLELERDNRSNLKAEYGRFSTNVEGVFAAGDCRRGQSLVVWAISEGRQAASEVDKYLLREEKDFDIDLGRQGDVTKRQQDSNKQTVMT

SEQ ID NO: 14753 - protein, 2216 aa, Theobroma cacao
MSSASAFNSLLQLRNGSYSLPSLNKSSITPQLNVAPSSRRKTRTARCSVTKKCSAALEKKFLGTRVLGSGSERLHLWQSDGQGKAPKLRVVVRSSLSGVPQKPLGLYDPSFDKDSCGVGFVAELSGGSSRKTITDALEMLIRMSHRGACGCETNTGDGAGILVALPHDFYKEVARDVGFEMPPSGEYGVGMFFLPTSESRREESKNVFTKVAESLGHRVLGWRSVPTDNSGLGNAALQTEPVIEQVFLTPTPRSKADLEQQMYILRRVSMVAIRAALNLQHGGVRDFYICSLSSRTVVYKGQLKPDQLQNYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPHRKALYEYFSALMEPWDGPALISFTDGRYLGATLDRNGLRPGRFYVTHSGRVIMASEVGVVDIPPEDVLRKGRLNPGMMLLVDFEKHTVVDDDALKQQYSLARPYGEWLESQKIELNNIVDSVQESERVTPAIAGAIPASNDDDNMEHMGIHGLLAPLKAFGYTVEALEMLLLPMAKDGTEALGSMGNDTPLAVMSNREKLTFEYFKQMFAQVTNPPIDPIREKIVTSMECMIGPEGDLTETTEEQCHRLSLKGPLLSVEETEAIKKMNYRGWRSKVLDITYSKDRGRKGLEETLDRICAEARDAIKEGYTLLVLSDRAFSSKRVAVSSLLAVGAVHHHLVKKLERTRVGLIVESAEPREVHHFCTLVGFGADAICPYLAIEAIWRLQVDGKIPPKSSGEFYSKHELVKKYFKASNYGMMKVLAKMGISTLASYKGAQIFEALGLSSEVIEKCFAGTPSRVEGATFEMLARDALHLHELAFPSRALAPGSAEAVALPNPGDYHWRKGGEVHLNDPLAIAQLQEAARSNSVAAYKEYAKRIHELNKSCNLRGMLKFKEAGVKIPLDEVEPASEIVKRFCTGAMSYGSISLEAHSTLAIAMNRIGGKSNTGEGGEQPSRMEPLPDGLMNPKRSAIKQVASGRFGVSSYYLTNADELQIKMAQGAKPGEGGELPGHKVIGDIAVTRNSTAGVGLISPPPHHDIYSIEDLAQLIHDLKNSNPSARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTLNEMVGRSDMLEVDKEVLRNNEKLQNIDLSLLLRPAADIRPEAAQYCIQKQDHGLDMALDQKLIKLSKAALEKGLPVYIETPICNVNRAVGTMLSHEVTKRYHLAGLPAGTIHIKLSGSAGQSLGSFMCPGIMLELEGDSNDYVGKGLSGGKIVVYPPKGSRFDPKENIVIGNVALYGATSGEAYFNGMAAERFCVRNSGAKAVVEGVGDHGCEYMTGGTVVVLGKTGRNFAAGMSGGIAYVLDVDGKFQSRCNPELVDLDKVEEEEDIMTLKMMIQQHQRHTNSQLAREVLADFENLLPKFIKVFPRDYKRVLAKVKEEEASKEALERAAKEAEERDEAELVEKDAFEELKKLAANLMNEESSQEGEAKPVKRPSRVSDAVKHRGFVAYEREGVQYRNPNVRMNDWKEVMEESKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPLKRTGKSIAIVGSGPSGLAAADQLNRMGHSVTVYERADRIGGLMMYGVPNMKADKVDVVQRRVNLMAEEGVKFVVNANVGIDPSYSLDQLREENDAIVLAVGATKPRDLPVPGRNLSGVHFAMEFLHANSKSLLDSNLQDGNYISAKGKKVVVIGGGDTGTDCIGTSIRHGCSSIVNLELLPQPPRTRAPGNPWPQWPRIFRVDYGHQEAAAKFGRDPRSYEVLTKRFVGDENGTLKGLEVVRVRWEKDASGKFQFKEVEGSVEIIEADLVLLAMGFLGPESTVADKLGLEQDNRSNFKAEYGRFATNVNGVFAAGDCRRGQSLVVWAISEGRQAAAQVDKYLTRKDEDVSVDGESQKDLVKRHEDLAQRQQTVMT

SEQ ID NO: 14754 - protein, 2216 aa, Theobroma cacao
MSSASAFNSLLQLRNGSYSLPSLNKSSITPQLNVAPSSRRKTRTARCSVTKKCSAALEKKFLGTRVLGSGSERLHLWQSDGPGKAPKLRVVVRSSLSGVPQKPLGLYDPSFDKDSCGVGFVAELSGGSSRKTITDALEMLIRMSHRGACGCETNTGDGAGILVALPHDFYKEVARDVGFEMPPSGEYGVGMFFLPTSESRREESKNVFTKVAESLGHRVLGWRSVPTDNSGLGNAALQTEPVIEQVFLTPTPRSKADLEQQMYILRRVSMVAIRAALNLQHGGVRDFYICSLSSRTVVYKGQLKPDQLQNYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPHRKALYEYFSALMEPWDGPALISFTDGRYLGATLDRNGLRPGRFYVTHSGRVIMASEVGVVDIPPEDVLRKGRLNPGMMLLVDFEKHTVVDDDALKQQYSLARPYGEWLESQKIELNNIVDSVQESERVTPAIAGAIPASNDDDNMEHMGIHGLLAPLKAFGYTVEALEMLLLPMAKDGTEALGSMGNDTPLAVMSNREKLTFEYFKQMFAQVTNPPIDPIREKIVTSMECMIGPEGDLTETTEEQCHRLSLKGPLLSVEETEAIKKMNYRGWRSKVLDITYSKDRGRKGLEETLDRICAEARDAIKEGYTLLVLSDRAFSSKRVAVSSLLAVGAVHHHLVKKLERTRVGLIVESAEPREVHHFCTLVGFGADAICPYLAIEAIWRLQVDGKIPPKSSGEFYSKHELVKKYFKASNYGMMKVLAKMGISTLASYKGAQIFEALGLSSEVIEKCFAGTPSRVEGATFEMLARDALHLHELAFPSRALAPGSAEAVALPNPGDYHWRKGGEVHLNDPLAIAQLQEAARSNSVAAYKEYAKRIHELNKSCNLRGMLKFKEAGVKIPLDEVEPASEIVKRFCTGAMSYGSISLEAHSTLAIAMNRIGGKSNTGEGGEQPSRMEPLPDGLMNPKRSAIKQVASGRFGVSSYYLTNADELQIKMAQGAKPGEGGELPGHKVIGDIAVTRNSTAGVGLISPPPHHDIYSIEDLAQLIHDLKNSNPSARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTLNEMVGRSDMLEVDKEVLRNNEKLQNIDLSLLLRPAADIRPEAAQYCIQKQDHGLDMALDQKLIKLSKAALEKGLPVYIETPICNVNRAVGTMLSHEVTKRYHLAGLPAGTIHIKLSGSAGQSLGSFMCPGIMLELEGDSNDYVGKGLSGGKIVVYPPKGSRFDPKENIVIGNVALYGATSGEAYFNGMAAERFCVRNSGAKAVVEGVGDHGCEYMTGGTVVVLGKTGRNFAAGMSGGIAYVLDVDGKFQSRCNPELVDLDKVEEEEDIMTLKMMIQQHQRHTNSQLAREVLADFENLLPKFIKVFPRDYKRVLAKVKEEEASKEALERAAKEAEERDEAELVEKDAFEELKKLAANLMNEESSQEGEAKPVKRPSRVSDAVKHRGFVAYEREGVQYRNPNVRMNDWKEVMEESKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPLKRTGKSIAIVGSGPSGLAAADQLNRMGHSVTVYERADRIGGLMMYGVPNMKADKVDVVQRRVNLMAEEGVKFVVNANVGIDPSYSLDQLREENDAIVLAVGATKPRDLPVPGRNLSGVHFAMEFLHANSKSLLDSNLQDGNYISAKGKKVVVIGGGDTGTDCIGTSIRHGCSSIVNLELLPQPPRTRAPGNPWPQWPRIFRVDYGHQEAAAKFGRDPRSYEVLTKRFVGDENGTLKGLEVVRVRWEKDASGKFQFKEVEGSVEIIEADLVLLAMGFLGPESTVADKLGLEQDNRSNFKAEYGRFATNVNGVFAAGDCRRGQSLVVWAISEGRQAAAQVDKYLTRKDEDVSVDGESQKDLVKRHEDLAQRQQTVMT

SEQ ID NO: 14755 - protein, 2209 aa, Gossypium raimondii
MSSAPTSSSLVQLRKSSCSLPSINKSYLNPQLNVTLSNRRKTSNARCSVTKKSSVALEKKFLGTRLRGSEKLHFWQSEGPGRVPKLRVMVRSALSGVPEKPLGLYDPSFDKDSCGVGFVAELSGDSSRKTVTDALEMLIRMSHRGACGCETNTGDGAGILVALPHGFYKEVAKDVGFELPPPGEYAVGMFFLPTSESRREESKNVFTKVAESLGHRVLGWRSVPTDNSGLGNAALQTEPVIEQVFLTPTPRSKADLEQQMYILRRVSMVAIRAALNLQHGGVRDFYICSLSSRTVVYKGQLKPDQLQNYYYADLGNERFTSYMALIHSRFSTNTFPSWDRAQPMRVLGHNGEINTLRGNINWMKAREGLLKCKELGLSKNEMKKLLPIVDASSSDSGAFDGVLELLVRAGRSLPEAVMMMIPEAWQNDKNMDPQRKALYEYFSALMEPWDGPALISFTDGRYLGATLDRNGLRPGRFYVTHSGRVIMASEVGVVDIPPEDVLRKGRLNPGMMLLVDFENHIVVDDEALKQQYSLARPYGEWLQRQKIELNDIVDSVQESERLPPSIAGSMPASNDDDNMDNLGIHGLLAPLKAFGYTVEALEMLLLPMAKDGTEALGSMGNDAPLAVMSNREKLTFEYFKQMFAQVTNPPIDPIREKIVTSMECMIGPEGDLTETTEEQCHRLSLKGPLLSIEETEAIKKMNFKGWRSKVLDITYSKDCGRKGLEETLDRICAEARDAIKEGYTLLVLSDRAFSSKRVAVSSLLAVGAVHHHLVKNLERTRVGLIVESAEPREVHHFCTLVGFGADAICPYLAIETIWRLQVDGKIPPKSSGEFHSKEELVKKYFKASNYGMMKVLAKMGISTLASYKGAQIFEALGLSSEVIEKCFARTPSRVEGATFEMLARDALHLHELAFPSRAFAPGSAEAVALPNPGDYHWRKGGEVHLNDPLAIAKLQEAARSNSVAAYKEYAKRIHELNKTCNLRGMLKFKESEAKIPLDEVEPASEIVKRFCTGAMSYGSISLEAHATLAIAMNTLGGKSNTGEGGEQPSRMVPLPDGSRNPKRSAIKQVASGRFGVSSYYLTNADELQIKMAQGAKPGEGGELPGHKVIGDIAVTRNSTAGVGLISPPPHHDIYSIEDLAQLIHDLKNSNPSARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTVTEMVGRSDMLEVDKEVLSNNEKLQNIDLSLLLRPAADIRPEAAQYCIQKQDHGLDMALDQKLIKLSTAALEKGLPVYIETPICNVNRAVGTMLSHEVTKRYHLAGLPAGTIHIKLSGSAGQSLGAFLCPGIMLELEGDSNDYVGKGLSGGKIVVYPPKGSRFDPKENIVIGNVALYGATSGEAYFNGMAAERFCVRNSGAKAVVEGVGDHGCEYMTGGTVVVLGKTGRNFAAGMSGGIAYVLDVDGKFQSRCNPELVDLDKIEEEEDIVTLKMMIQQHQRHTNSQLAREVLADFESLLPKFIKVFPRDYKRVLAKMKDQEASERAAKEAEEQDEVELMEKDAFEELKKLAAASSNEKSSLTVEAEPVKRPTQVSDAVKHRGFVAYEREGVQYRDPNVRMNDWKEVMEESKPGPLLKTQSARCMDCGTPFCHQENSGCPLGNKIPEFNELVYQNRWREALDRLLETNNFPEFTGRVCPAPCEGSCVLGIIENPVSIKSIECAIIDKGFEEGWMVPRPPLKRTGKSIAIIGSGPSGLAAADQLNRMGHSVTVYERADRIGGLMMYGVPNMKTDKVDVVQRRVNLMAEEGVKFVVNANIGKDPSYSLDRLREENDAIVLAIGATKPRDLPVPGRDLSGVHFAMEFLHANTKSLLDSDLQDGNYISAKGKKVVVIGGGDTGTDCIGTSIRHGCSSIVNLELLPQPPQTRAPGNPWPQWPRIFRVDYGHQEAATKFGKDPRSYEVLTKRFIGDDNGNVKGLEVVRVRWEKDASGRFQFKEVEGSEEIIEADLVLLAMGFLGPESTLAEKLGVEQDNRSNLKAEYGRFTTNVDGVFAAGDCRRGQSLVVWAISEGRQAAAQVDKYLTKEDKDTSVEGENQDSVKRHQDLPQKQQTVMK

SEQ ID NO: 14756 - protein, 2216 aa, Vitis vinifera
MSATSGSGSVVQIRNNSGSGLVPSRKRPTFAHQFNVTPLSRFNNKSKGSSCYVSKRTNVVENKFLGTRLRGCGSERLHFWQSDGPGRSPKLRVVVRSALSQVPEKPLGLYDPSFDKDSCGVGFVAELSGESSRKTVTDAVEMLVRMSHRGACGCETNTGDGAGILVGLPHDFFKEVAQDVGFELPPPGEYAVGMFFLPTSHTRREESKNVFTKVAESLGHTVLGWRSVPTNNSGLGNSALQTEPVVEQVFLTPTPRSKADFEQQMYILRRVSMVAIRAALNLQHGGVRDFYICSLSSRTVVYKGQLKPDQVKGYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPDRKALYEYFSALMEPWDGPALISFTDGRYLGATLDRNGLRPGRFYVTHSGRVIMASEVGVVDIAPEDVRRKGRLNPGMMLLVDFENHVVVDDEALKQQYSLARPYGEWLKRQKIELKDIVESVHESDKVSPTIAGVMPASNQDDSMENMGIYGLLAPLKTFGYTVEALEMLLLPMAKDGTEALGSMGNDAPLAVMSNREKLTFEYFKQMFAQVTNPPIDPIREKIVTSMECMIGPEGDLTETTEEQCHRLSLKGPLLSIQEMEAIKKMNYRGWRSKVLDITYSKNRGRKGLEETLDRLCSEAHHAIKQGYTVLVLSDRAFSSKRVAVSSLLAVGAVHQHLVQKLERTQVGLIVESAEPREVHHFCTLVGFGADAICPYLAIEAILRLQVDGKIPPKASGEFHSKDELVKKYFKASNYGMMKVLAKMGISTLASYKGAQIFEAVGLSSEVIQRCFTGTPSRVEGATFEMLAQDALELHEMAFPTRVFPPGSAEAVALPNPGDYHWRKGGEVHLNDPLAIAKLQDAARSNSVAAYKEYSKRIQELNKTCNLRGLLKFKEAEVKVPLDEVEPASEIVKRFCTGAMSYGSISLEAHTTLAIAMNRIGGKSNTGEGGENPSRLESLPDGSLNPKRSAIKQVASGRFGVSSYYLTNADELQIKMAQGAKPGEGGELPGHKVIGDIAVTRNSTAGVGLISPPPHHDIYSIEDLAQLIHDLKNANPSARVSVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTLSEMVGRADMLEVDKEVTKNNEKVQNIDLSLLLRPAADIRPEAAQYCVQKQDHGLDMALDQKLIALSKAALEKSLPVYIETPIRNVNRAVGTMLSHEVTKRYHSAGLPAETIHIKLSGSAGQSLGAFLCPGIMLELEGDSNDYVGKGLSGGKIVVYPPRQSKFDPKENIVIGNVALYGATSGEAYFNGMAAERFCVRNSGARAVVEGVGDHGCEYMTGGTVVVLGKTGRNFAAGMSGGIAYVFDVDEKFSSRCNPELVDLDKVEKEEDIMTLRMMIQQHQRHTNSQLAKEILADFDNLLPKFIKVFPRDYKRVIESMKQEEASKKALEQDTQEAEDQDEKELMEKDAFEELKKLAAASLNGKNSQKVEEAEPDKRPTRVANAVKHRGFIAYKREGISYRDPNSRMNDWKEVMVETKPGPLLKTQSARCMDCGTPFCHQENSGCPLGNKIPEFNELVHQNRWREALDRLLETNNFPEFTGRVCPAPCEGSCVLGIIENPVSIKSIECSIIDKAFEEGWMVPRPPPKRTGKRVAIVGSGPAGLAAADQLNRMGHFVTVFERADRIGGLMMYGVPNMKADKVDVVQRRVNLMAEEGVNFVVNASVGTDPSYSLDRLREENDAIVLAVGATKPRDLPVPGRELSGIHFAMKFLHANTKSLLDSNLEDGNYISAKGKKVVVIGGGDTGTDCIGTSIRHGCSSVVNLELLPQPPQTRAPGNPWPQWPRIFRVDYGHQEAAAKFGKDPRSYEVLTKRFIGDENGVLKGLEVIRVQWEKDASGKFQFKEVEGSQEVIEADLVLLAMGFLGPEVTVAEKLGLERDNRSNLKADYGRFATSVEGVFAAGDCRRGQSLVVWAISEGRQAASQVDKFLMREDEHLTNNWQDDNIKRQQKSIKHTVMT

SEQ ID NO: 14757 - protein, 2209 aa, Gossypium raimondii
MSSAPTSSSLVQLRKSSCSLPSINKSYLNPQLNVTLSNRRKTSNARCFVTKKSSVALEKKFLGIRLRGSEKLHFWQSEGPGRVPKLRVMVRSALSGVPEKPLGLYDPSFDKDSCGVGFVAELSGDSSRKTVTDALEMLIRMSHRGACGCETNTGDGAGILVALPHGFYKEVAKDVGFELPPPGEYAVGMFFLPSSESRREESKNVFTKVAESLGHRVLGWRSVPTDNSGLGNAALQTEPVIEQVFLTPTPRSKADLEQQMYILRRVSMVAIRAALNLQHGGVRDFYICSLSSRTVVYKGQLKPDQLQNYYYADLGNERFTSYMALIHSRFSTNTFPSWDRAQPMRVLGHNGEINTLRGNINWMKAREGLLKCKELGLSKNEMKKLLPIVDASSSDSGAFDGVLELLVRAGRSLPEAVMMMIPEAWQNDKNMDPQRKALYEYFSALMEPWDGPALISFTDGRYLGATLDRNGLRPGRFYVTHSGRVIMASEVGVVDIPPEDVLRKGRLNPGMMLLVDFENHIVVDDEALKQQYSLARPYGEWLQRQKIELNDIVDSVQESERLPPSIAGSMPASNDDDNMDNLGIHGLLAPLKAFGYTVEALEMLLLPMAKDGTEALGSMGNDAPLAVMSNREKLTFEYFKQMFAQVTNPPIDPIREKIVTSMECMIGPEGDLTETTEEQCHRLSLKGPLLSIEETEAIKKMKFKGWRSKVLDITYSKDCGRKGLEETLDRICAEARDAIKEGYTLLVLSDRAFSSKRVAVSSLLAVGAVHHHLVKNLERTRVGLIVESAEPREVHHFCTLVGFGADAICPYLAIETIWRLQVDGKIPPKSSGEFHSKEELVKKYFKASNYGMMKVLAKMGISTLASYKGAQIFEALGLSSEVIEKCFARTPSRVEGATFEMLARDALHLHELAFPSRAFAPGSAEAVALPNPGDYHWRKGGEVHLNDPLAIAKLQEAARSNSVAAYKEYAKRIHELNKTCNLRGMLKFKESEAKIPLDEVEPASEIVKRFCTGAMSYGSISLEAHATLAIAMNTLGGKSNTGEGGEQPSRMVPLLDGSRNPKRSAIKQVASGRFGVSSYYLTNADELQIKMAQGAKPGEGGELPGHKVIGDIAVTRNSTAGVGLISPPPHHDIYSIEDLAQLIHDLKNSNPSARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTVTEMVGRSDMLEVDKEVLSNNEKLQNIDLSLLLRPAADIRPEAAQYCIQKQDHGLDMALDQRLIKLSTAALEKGLPVYVETPICNVNRAVGTMLSHEVTKRYHLAGLPAGTIHIKLSGSAGQSLGAFLCPGIMLELEGDSNDYVGKGLSGGKIVVYPPKGSRFDPKENIVIGNVALYGATSGEAYFNGMAAERFCVRNSGARAVVEGVGDHGCEYMTGGTVVVLGKTGRNFAAGMSGGIAYVLDVDGKFQSRCNPELVDLDKIEEEEDIVTLKMMIQQHQRHTNSQLAREVLADFESLLPKFIKVFPRDYKRVLAKMKDQKASERAAKEAEEQDEVELMEKDAFEELKKLAAASSNEKSSLTVEAEPVKRPTQVSDAVKHRGFVAYEREGVQYRDPNVRMHDWKEVMEESKPGPLLKTQSARCMDCGTPFCHQENSGCPLGNKIPEFNELVYQNRWREALDRLLETNNFPEFTGRVCPAPCEGSCVLGIIENPVSIKSIECAIIDKGFEEGWMVPRPPLKRTGKSIAVIGSGPSGLAAADQLNRMGHSVTVYERADRIGGLMMYGVPNMKTDKVDVVQRRVNLMAEEGVKFVVNANIGKDPSYSLDRLREENDAIVLAIGATKPRDLPVPGRDLSGVHFAMEFLHANTKSLLDSDLQDGNYISAKGKKVVVIGGGDTGTDCIGTSIRHGCSSIVNLELLPQPPQTRAPGNPWPQWPRIFRVDYGHQEAATKFGKDPRSYEVLTKRFIGDDNGTVKGLEVVRVRWEKDASGRFQFKEVEGSEEIIEADLVLLAMGFLGPESTLAEKLGVEQDNRSNLKAEYGRFTTNVDGVFAAGDCRRGQSLVVWAISEGRQAAAQVDKYLTKEDKDTSVEGENQDSVKRHQDLPQKQQTVMK

SEQ ID NO: 14758 - protein, 2208 aa, Mimulus guttatus
MSAVSGSGIHVKGGGLVKPPCAPSHQLNAVAALSRRVRASQGFTAKQRTVRLENKFVFGTSLKSGAAERLHLWQTTGAGRSPKIRFVVKNSMSQVPEKPLGLYDPSFDKDSCGVGFVAELSGESSRKTVTDAIEMLVRMSHRGACGCETNTGDGAGILVGVPHDFYKVALKDAGFELPPLGEYAVGMFFLPTSDSRREQSKIVFAKVAESLGHTVLGWRSVPTDNSGLGNSAMQTEPVIEQVFLTASPRSKADFEQQMYILRRVAMVAIRAALNIQHGAVRDFYICSLSSRTVVYKGQLKPDQLKGYYYADLGNERFTSYMALIHSRFSTNTFPSWDRAQPMRVLGHNGEINTLRGNVNWMRAREGLLKCKELGLSKAEMKKLLPIVDASSSDSGSFDGVLELLVRAGRSLPEAVMMMIPEAWQNDKNMDPSRKALYEYFSALMEPWDGPALISFTDGRYLGATLDRNGLRPGRFYVTHSGRVIMASEVGVVDIPPEDVSRKGRLNPGMMLLVDFEKHVVVDDEALKQQYSLSRPYGEWLQRQKLQLKDIVESVPESDRVPPPMAGVLPASPDDENMENMGLHGLLSPLKAFGYTVESLEMLLLPMAKDGIEALGSMGNDAPLAVMSNREKLTFEYFKQMFAQVTNPPIDPIREKIVTSMECMVGPEGDLTETTEEQCHRLSLKGPLLSIEEMEAMKKMNHRGWRSKVLDITFSKSHGKKGLEETLDRICTEAHTAIKEGYTTLVLSDRAFSPKRVAVSSLLAVGAVHHHLVKNLERTRVALIVESAEPREVHHFCTLVGFGADAICPYLAVEAIWRLQVDGKIPPKANGEFHPKGELVKKYFRASNYGMMKVLAKMGISTLASYKGAQIFEAVGLSSEVMERCFKGTPSRVEGATFEALAQDALQLHEVAFPTRALPPGSAEAVALPNPGDYHWRKGGEVHLNDPFAIAKLQEAARSNSVSAYKEYSKRVQELNKSCNLRGLLKFKDAEAKVPLEEVEPASEIVKHFVTGAMSYGSISLEAHSTLAIAMNKIGGKSNTGEGGEQPSRMEPLPDGSRNPKRSSIKQVASGRFGVSSYYLTNADELQIKMAQGAKPGEGGELPGHKVIGDIAVTRNSTAGVGLISPPPHHDIYSIEDLAQLIHDLKNANPDARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEELREIMADLGFRTLREMVGRSDMLELDKDVAENNQKLRNIDLSLLLRPAADIRPDAAQYCVQKQDHGLDMALDNKLIALSKPALEKSLPVYIESPICNVNRAVGTMLSHEVTKRYHMAGLPSDTIHIKLSGSAGQSLGAFLCPGITLELEGDSNDYVGKGLSGGKITVYPPKGSTFDPKENIVIGNVALYGATTGEAYFNGMAAERFAVRNSGATAVVEGVGDHGCEYMTGGTVVVLGKTGRNFAAGMSGGIAYVLDADSTFKSRCNLELVDLDPVEEEEDILTLRMMIQQHQRHTGSQLAKEVLANFDSLLPKFIKVFPRDYKHILASMKAGDVAKAAAENAAKEAEVEEEAELNKKDAFQVLKDMSVVSDDNNTSQAEEEQLLKRPTSVSNPVKNGGFVAYEREGVSYRDPTERMEDWNEVMVESKPGPLLKTQSARCMDCGTPFCHQENSGCPLGNKIPEFNELVYQNRWREALDRLLETNNFPEFTGRVCPAPCEGSCVLGIIENPVSIKSIECSIIDKAFAEGWMVPRPPLKRTGKKVAIVGSGPSGMAAADQLNKMGHSVTVFERSDRVGGLMMYGVPNMKTDKIDIVKRRVDLMANEGVNFVVNANVGQDPSYSLDRLRDEHDAIILAVGATKPRDLPVPGRDLSGVHFAMEFLHANTKSLLDSNLEDGNYISAKGKKVVVIGGGDTGTDCIGTSIRHGCTNIINLELLPEPPRTRAAGNPWPQWPRVFRVDYGHQEAATKFGKDPRSYEVLTKRFIGGEDGVVKGLELVRVQWAKDESGRFQFKEVEGSEEIIEADLVLLAMGFLGPEQTMAEKLGLEQDNRSNIKAEYGRFSTNVEGVFAAGDCRRGQSLVVWAISEGRQAASQVDKFLTKDESDAAQGQEDEFADKHQDGNRQTVKT

SEQ ID NO: 14759 - protein, 2220 aa, Lactuca sativa
MSVALNHAVQARPDADVTKPFASASRPLSGLARIGVGRSRTWTSRGSVVKQSSLLGKKLYGTRLQRGSVSETLHQWKSDGPGRDPKLKVVVRSALSLVPEKPLGLYDPSFDKDACGVGFVAELSGKSNRNTVTDAIEMLVRMSHRGACGCETNTGDGAGILVGLPHDFYKEVAKDEGFELPPPGKYAVGMFFLPTSDTRREQSKIVFTKVAESLGHTVLGWRTVPTDNSGLGKSAIQTEPVIEQVFLTPTSRSKADFEQQMYILRRVSMVAIRAALNLQHGGIRDFYICSLSSRTIVYKGQLKPNQLKEYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPKRKALYEYFSALMEPWDGPALVSFTDGRYLGATLDRNGLRPGRFYVTHSGRVVMASEVGVVDIPPEDVSRKGRLNPGMMLLVDFEKHTVVDDEALKKQYSLQRPYGKWLEQQKIELKHIVESVNKSARACPPIAGVSQASPNDENMENMGIRGLLAPLKAFGYTIEALEMLLLPMAKDGVEALGSMGNDAPLAVMSDREKLTFEYFKQMFAQVTNPPIDPIREKIVTSMECMVGPEGDLTETTEEQCHRLSLKGPLLSIEEMESIKKMNFRGWRSKVLDITYPKELGKKGLEETLDRICSQAHNAIKEGYTTLVLSDRAFSSKRVAVSSLLAVGAVHHHLVKKLERTRVALMVESAEPREVHHFCTLVGFGVDAICPYLAVEAIWRMQVDGKIPPKSNGDFHSKEELVKKYYKASHYGMMKVLAKMGISTLASYKGAQIFEAVGLSTEVMERCFAGTPSRVEGATFEALAGDALQLHDLGFPSRQFPPNSAEAVALPNPGDYHWRKGGEVHLNDPLAIAKLQEAARGNSVEAYKEYSKRIHELNKTCNLRGLLKFKEGKVKVPLEEVEPASEIVKRFCTGAMSYGSISLEAHSTLAIAMNKIGGKSNTGEGGENPSRLEPLPDGSMNPKRSAIKQVASGRFGVNSYYLTNADEIQIKMAQGAKPGEGGELPGHKVIGDIATTRNSTAGVGLISPPPHHDIYSIEDLAQLIHDLKNANPSARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEMRELMSEMGFRTVNEMVGRADMLEVDKELTKSNEKLKNIDLSLLLRPAADIRSDAAQTCVQKQDHGLDMALDQRLISLAKPALEKGLPVYIESPICNVNRAVGTMLSHEVTKRYHLPGLPADTIHIKLHGSAGQSIGAFLCPGIMLELEGDSNDYVGKGLSGGKIVVYPPKGSGFDPKENIVIGNVALYGATSGEAYFNGMAAERFCVRNSGAKTVVEGVGDHGCEYMTGGTVVILGKTGRNFAAGMSGGIAYVLDVDLKFRSRCNTELVDLDKVEDEEDIMTLKMLIQQHQRHTNSQLAKEVLADFDHLLPKFIKVFPRDYKRILATMKETEVAKKAADLAAEEADIREEDVLKEKDAFEELKKLAAKSLTETVNQLIETVNQVKEDEKAEQATRPSRVADAVKHRGFVAYEREGVSYRDPSVRMNDWNEVMEESKPGPLLTTQSARCMDCGTPFCHQENTGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPSGLAAADQLNRMGHTVTVLERADRIGGLMMYGVPNMKTDKIDVVQRRVDLMATEGVNFVVNANVGTDPVYSIERLRQENDAVILAVGATKPRDLPVPGRELSGVHFAMEFLHANTKSLLDSNLEDGNYISAKGKKVVVIGGGDTGTDCIGTSIRHGCTSIVNLELLPEPPRTRAPGNPWPQWPRVFRVDYGHQEAATKFGKDPRSYEVLTKRFISDENGAVKGLELVRVQWGKDESGRFQFKEVEGSEEILEADLVLLAMGFLGPESTIADKLGLEKDGRSNVKAEYGRFATNVEGVFAAGDCRRGQSLVVWAISEGRQAAAQVDKFVMKEEEEIEDGRLQIEEGKKREEQQAFRT

SEQ ID NO: 14760 - protein, 1600 aa, Vinca minor
MAKDGVEALGSMGNDAPLAVMSDREKLTFEYFKQMFAQVTNPPIDPIREKIVTSMECMVGPEGDLTETTEEQCHRLSLKGPLLSIEEMEAIKRMTYRGWRSKVLDITFSKERGRKGLEETLDRICSEAHQAIKEGYTTLVLSDRAFSPKRVAVSSLLAVGAVHHHLVKNLERTQVALIIESAEPREVHHFCTLVGFGADAICPYLAVEAIWRLQVDGKIPPKATGEFHSKAELVKKYFKASNYGMMKVLAKMGISTLASYKGAQIFEAVGLSSEIMERCFKGTPSRVEGATFEALAHDALVLHELAFPSRALPAGSAEAVALPNPGEYHWRKGGEIHLNDPLAIAKLQEAAKSNSVAAYKEYSKRIQELNKSCNLRGLLKFKEGVKVLLDEVEPASEIVKRFCTGAMSYGSISLEAHSTLAIAMNRLGGKSNTGEGGEQPSRMEPLPDGSMNPKRSAIKQVASGRFGVSSYYLTNADELQIKMAQGAKPGEGGELPGHKVVGDIAVTRNSTAGVGLISPPPHHDIYSIEDLAQLIHDLKNANPGARISVKLVSEAGVGVIASGVVKGHADHVLISGHDGGTGASRWTGIKSAGLPWELGLAETHQTLVANDLRGRTTLQTDGQLKTGRDVAIATLLGAEEFGFSTAPLITLGCIMMRKCHKNTCPVGIATQDPVLREKFAGEPEHVINFFFMLAEELREIMSQLGFRSIKEMIGRSDMLELDGDLVKDNEKLKNIDLSLLLQPAADIRPDAAQYCIQKQDHGLDLALDNKLIELSKSALEKSVPVYIETAICNVNRSVGTMLSHKVTKRHHMVGLPADTIHVKFNGSAGQSFGAFVCPGVTLELEGDSNDYVGKGLSGGKIIVYPPKGSNFDPKENIVIGNVALYGATAGEAYFNGMAAERFCVRNSGAKAVVEGVGDHGCEYMTGGTVVILGKTGRNFAAGMSGGVAYVLDVDSTFQSRCNPELVDLDKVEDEDDILTLKMMIQQHQRHTKSQLAKEVLADFNNLLHKFIKVFPRDYKRVLASMKEKGNSKLAAERAVKEIEENEEAELMEKDAFEELKKLADSSLNEKVEEPQPNKRPTRVAVAVKHRGFVAYERESVSYRDPNTRISDWKEVMIEGKPGPLLSTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPPKRTGRRVAVVGSGPAGLAAADQLNKMGHSVTVFERADRIGGLMMYGVPNMKADKVDVVQRRVDLMKKEGVNFVVNANVGNDPSYALDRLREDHDAIVLAVGSTKPRDLPVPGRELSGVHFAMEFLHANTKSLLDSDLQDGKFISAKSKKVVVIGGGDTGTDCIGTSIRHGCSSIVNLELLPQPPNTRAPGNPWPQWPRVFRVDYGHQEAETKFGKDPRSYEVLTKQFVGDENGVVKGLEVVRVEWEKDANGRFQFKEVEGSNEIIEADLVLLAMGFLGPESTIAEKLGLETDNRSNFKAEYGRFSTSVEGVFAAGDCRRGQSLVVWAISEGRQAASQVDKFLMKDETDAESNIGKQEEFTKRRQVSNKHTTV

SEQ ID NO: 14761 - protein, 2215 aa, Ricinus communis
MSATSSSSSLLQPRRGANLNITKQPCSISPKLNVIAPISRRTSRPTRCSVTKKSAVLDKKIFGTRLRAAGTERLHFWQSDGPGCSPKLRVMVRSALSGVPEKPLGLYDPSFDKDSCGVGFVAELSGENSRKTVTDALEMLIRMSHRGACGCETNTGDGAGILVALPHDFYKEVAKESGFELPGPGEYAVGMFFLPTSDNRREESKNVFTKVAESLGHTVLGWRRVPTDNSGLGNAALQTEPVVEQVFLTPSPRSKADFEQQMYILRRVSMVAIRAALNLQHGGVRDFYICSLSSRTIVYKGQLKPVQVKDYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPQRKALYEYFSALMEPWDGPALISFTDGRYLGATLDRNGLRPGRFYVTRSGRVIMASEVGVVDIPPEDVLRKGRLNPGMMLLVDFEKHTVVDDEALKQQYSLSRPYGEWLKRQKITLKDIVTSVPESDIALPAIAGVLPASNDDDNMENMGIHGLVAPLKAFGYTVEALEMLLLPMAKDGTEALGSMGNDAPLAVMSDREKLTFEYFKQMFAQVTNPPIDPIREKIVTSMECMIGPEGDLTETTEEQCHRLSLKGPLLSIEEMESIKKMNYRGWRSKVLDITYSKERGRKGLEETLDRICAEARDAIREGYTLLVLSDRAFSSERVAVSSLLAVGAVHHHLVKKLERTRIGLIVESAEPREVHHFCTLVGFGADAICPYLAIEAIWRLQVDGKIPPKSTGDFHSKEELVKKYFKASNYGMMKVLAKMGISTLASYKGAQIFEALGLSSEVIEKCFAGTPSRVEGATFEMLASDALHLHGLAFPTRVFPPGSAESVALPNPGDYHWRKGGEIHLNDPLAIAKLQEAARGNSVAAYKEYSKRIQELNKSCNLRGLLKFKEADVKVPLDEVEPASEIVKRFCTGAMSYGSISLEAHSTLAIAMNSLGGKSNTGEGGEQPSRMEPLPDGSMNPRRSAIKQVASGRFGVSSYYLTNADELQIKMAQGAKPGEGGELPGHKVIGDIAVTRNSTAGVGLISPPPHHDIYSIEDLAQLIHDLKNSNPGARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEELREIISQLGFRTLKEMVGRSDMLEVDKEVIKNNEKLENIDLSLLLRPAADIRPEAAQYCVQKQDHGLDMALDKKLITLSQASLEKKLPVYIESPICNVNRAVGTMLSHEVTKRYHLAGLPADTIHVKLTGSAGQSLGAFLCPGITLELEGDSNDYVGKGLSGGKVVVYPPKGSLFDPKENIVIGNVALYGATNGEAYFNGMAAERFCVRNSGARAVVEGVGDHGCEYMTGGTVVVLGTTGRNFAAGMSGGVAYVLDVDGKFHSRCNPELVDLDKVEEEEDIMTLRMMIQQHQRHTNSQLAREVLADFETLLPKFIKVFPRDYKRVLAKMKQEEALKDSAEEDEEQDEAELKEKDAFEELKKMAAASLNGASSQKDEDSEPLKRPTQVNGAVKHRGFIAYEREGVQYRDPNVRMNDWNEVMQESEPGPLLKTQSARCMDCGTPFCHQENSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPAGLAAADQLNRMGHLVTVYERADRIGGLMMYGVPNMKADKVDIVQRRVNLMAEEGINFVVSANVGIDPLYSLERLREENDAIVLAVGATKPRDLPVPGRELSGVHFAMEFLHANTKSLLDSNLEDGNYISAKWKKVVVIGGGDTGTDCIGTSIRHGCSSIVNLELLPEPPRSRAPGNPWPQWPRTFRVDYGHQEAAAKFGKDPRSYEVLTKRFIGDENGDVKGLEVVCVRWEKDASGKFQFKEVEGSEEIIEADLVLLAMGFLGPEANVADKLGLERDNRSNFKADYGRFSTSVEGVFAAGDCRRGQSLVVWAISEGRQTASQVDKYLMREDVTISPDAQDDLVKRRQDLTKKHQDNKHTVMT

SEQ ID NO: 14762 - protein, 2217 aa, Euphorbia peplus
MSAGSSSLLQPRAKSSALSALNKPAISHKLNVVAPFSLRNTRAGPCSGLRNSEKKLFGTKLRTSGSERLLHLWQSDGPGRSPKLRVVVRSALSGVPEKPLGLYDPSFDKDSCGVGFVAELSGETSRKTVTDALEMLIRMTHRGACGCEANTGDGAGILVALPHDFYKEVAKDNGFELPPPGEYAVGMLFLPTSENRREESKNVFTKVAESLGHTVLAWRHVPTENSGLGKSALQTEPVVEQVFLTPSPRSKADFEQQMYILRRVSMVAIRAALNLQHGGIRDFYICSLSSRTVVYKGQLKPVQLKDYYYADLGNERFTSYMALIHSRFSTNTFPSWDRAQPMRVLGHNGEINTLRGNVNWMKAREGLLKCKELGLSKNELKKLLPIVDASSSDSGAFDGVLELLVRAGRSLPEAMMMMIPEAWQNDKNMDPQRKALYEYFSALMEPWDGPALISFTDGRYLGATLDRNGLRPGRFYVTRSGRVIMASEVGVVDIPPEDVLRKGRLNPGMMLLVDFEKHIVVDDDALKQQYSIARPYGEWLKKQRIELKDVVGSVQESDVNVPAIAGVIPASMEDNNMENMGIHGLIAPLKAFGYTREALEMLLLPMAKDGTEALGSMGNDAPLAVMSDREKLTFEYFKQMFAQVTNPPIDPIREKIVTSMQCMIGPEGDLTETTEDQCHRLSLKGPLLSIREMEAIKKMNYRGWRSKVLDITYSKERGRKGLEETLDRICVEAREAIKMGYTLLVLSDRAFSSKRVSVSSLLAVGAVHHHLVEKLERTRIGLIVESAEPREVHHFCTLVGFGADAICPYLAVEAIWRLQVDGKIPPKSSGDFHSKDELVKKYFKASNYGMMKVLAKMGISTLASYKGAQIFEALGLSSEVIEKCFAGTPSRVEGATFEMLARDSLHLHEMAFPTRVYPPGSAESTALPNPGDYHWRKGGEIHLNDPLAIAKLQEAARGNSVEAYKEYSKRIQELNKACNLRGLLKFKEAEVKVPLEEVEPASEIVKRFCTGAMSYGSISLEAHTTLAMAMNKIGGKSNTGEGGEQPSRMEPLLDGTMNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEELREIMSMLGFRTINEMVGRSDMLEVDKEVIKNNEKLENIDLSLLLRPAADIRPEAAQYCVQKQDHGLDMALDLKLISLAQPALEKGFPVYIDTPIRNVNRAVGTMLSHEVTKRYHMAGLPADTIHVKLSGSAGQSLGAFLCPGITMELEGDSNDYVGKGLSGGKIVVYPPKGSLFDPKENIVIGNVALYGATTGEAYFNGMAAERFCVRNSGARAVVEGVGDHGCEYMTGGTVVVLGKTGRNFAAGMSGGIAYVLDVDGKFHSRCNPELVDLDRVEEEEDIMTLKMMIQQHLRHTNSQLAREILADFDPLLPKFIKVFPRDYKRILAKVKQEASFTEAKQAPVKEEAEEQDEVELIEKDAFEELKKMAAASLKESSQKVEDAEPLGRPSRVNNAVKHRGFIAYEREGVQYRDPDVRMNDWNEVMEETKPGPLLNTQSARCMDCGTPFCHQEHSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPSGMAAADQLNRMGHLVTVYERSDRIGGLMMYGVPNMKTDKVDVVQRRVDLMAREGINFVVNANIGIDPEYSLDKLREENDAIVLAVGATKPRDLPVPGREFKGVHFAMEFLHANTKSLLDSNLQDGNYISAKGKKVVVIGGGDTGTDCIGTSIRHGCTSMVNLELLPKPPQTRAPGNPWPQWPRVFRVDYGHQEATAKFGKDPRSYEVLTKRFVGDENGNVKGLEVIRVQWEKDSSGRFQFKEIEGSEEIIAADIVLLAMGFLGPEANLAEKLGLERDNRSNFKAEYGRFATSVEGIFAAGDCRRGQSLVVWAISEGRQTASQVDKYLMEDPEDSTGTADNQDDLVKKQQDLTKRQQDNKHTVMT

SEQ ID NO: 14763 - protein, 2217 aa, Citrus sinensis
MSATASSSFVQLRANSSLTSLSRKSGYPQSNIVSPLSSGGRAKAARCAAAKKSTVLERRFFGNQLRLAGSERVHLWRSDGPGKSPKLRVVVRSALSGVPEKPLGLYDPKFDKDSCGVGFVAELSGESSRKTITDALEMLVRMAHRGACGCETNTGDGAGILVALPHDFFKEAAKNVGFQLPPPGEYAVGMFFLPQSENRREESKKVFTKVAESLGHTVLGWRAVPTDNSGLGNSALQTEPVVEQVFLTPSLRSKVDFENQMYILRRVSMAAIRESLNLEHGGAKDFYICSLSSRTVVYKGQLKPIQMKDYYYADLGNERFTSYMALIHSRFSTNTFPSWDRAQPMRILGHNGEINTLRGNVNWMKAREGLLKCKELGLSKDEMKKLLPIVDVSSSDSGAFDGVLELLVRAGRSLPEAVMMMIPEAWQNDKNMDPQRKALYEYFSALMEPWDGPALISFTDGRYLGATLDRNGLRPGRFYITHSGRVIMASEVGVVDIPPEDVLRKGRLNPGMMLLVDFEKRIVVDDEALKQQYSLARPYGEWLQRQKIELKNIVESIHKSERVSPGIAGVLPASNDDDNMENMGIHGLLAPLKAFGYTVEALEMLMLPMAKDGTEALGSMGNDAPLAVMSNREKLTFEYFKQMFAQVTNPPIDPIREKIVTSMECMIGPEGVLTETTEEQCHRLSLKGPLLSIEEMEAIKRMNYRGWRSKVLDITYSKDHGRRGLEETLDRICAEARDAIKEGYTLLVLSDRAFSSKRVAVSSLLAVGAVHHHLVKNLERTRIGLIVESAEPREVHHFCTLVGFGADAICPYLATEAIWRLQVDGKIPPKASGEFHSKDELVKKYFKASNYGMMKVLAKMGISTLASYKGAQIFEALGLSSEVIEKCFAGTPSRVDGATFEVLASDALHLHELAFPTRILPPGSAEAVALPNPGDYHWRKGGEIHLNDPLAIAKLQEAARGNSVAAYKEYSKRIQELNKTCNLRGLLKFKEADVKIPLEEVEPASEIVKRFCTGAMSYGSISLEAHTTLATAMNKIGGKSNTGEGGEQPSRMEPLSDGSMNPKRSAIKQVASGRFGVSSYYLTNADELQIKMAQGAKPGEGGELPGHKVIGDIAVTRNSTAGVGLISPPPHHDIYSIEDLAQLIYDLKNANPGARISVKLVSEAGVGVIASGVVKGHADHVLISGHDGGTGASRWTGIKNAGLPWELGLAETHQTLVANDLRGRTILQTDGQLKTGRDVAIAALLGAEEFGFSTAPLITLGCIMMRKCHKNTCPVGIATQDPVLREKFAGEPEHVINFFFMLAEELREIMSQLGFRTITEMIGRSDMLEVDKEVTKTNEKLENIDLSLLLRPAADLRPEAAQYCVQKQDHGLDMALDQKLIKLSKAALEKALPVYIETPVCNVNRAVGTMLSHEVTKRYHLVGLPADTIHIKLTGSAGQSVGAFLCPGILLELEGDSNDYVGKGLSGGKIVAYPPKGSLFDPKVNIVIGNVALYGATSGEAYFNGMAAERFCVRNSGARAVVEGVGDHGCEYMTGGTVVVLGKTGRNFAAGMSGGIAYVLDVDGKFRSRCNPELVDLDKVEEEEDIITLRMMIQQHQRYTNSQLAKEVLADFENLLPKFIKVFPRDYKRVLASMKVAAAQEAAEDAVKDAEEPDEADFKEKDAFEELKKMAIASLNEKSNQEAEQVEPTKRPSRVADAVKHRGFIAYEREGVQYRDPNIRMNDWKEVMEESKPGPLLKTQSARCMDCGTPFCHQENSGCPLGNKIPEFNELVYQNRWREALDRLLETNNFPEFTGRVCPAPCEGSCVLGIIENPVSIKNIECAIIDKAFEEGWMVPRPPPRRTGKRVAIVGSGPAGLAAADQLNKMGHLVTVYERADRIGGLMMYGVPNMKADKVDVVQRRVNLMAEEGVKFVVNANVGIDPMYSLDQLREENDAIVLAVGSTKPRDLPVPGRDLSGIHFAMEFLHSNTKSLLDSNLEDDSYISAKGKKVVVIGGGDTGTDCIGTSIRHGCSSIVNLELLPQPPQTRAPGNPWPQWPRVFRVDYGHQEVAAKFGKDPRSYEVLTKRFIGDENGVVKGLEIVRVHWEKDASGKFQFKEVEGSEEIIGADLVLLAMGFLGPEATVAEKLGLERDNRSNFKAEYGRFATSVDGVFAAGDCRRGQSLVVWAISEGRQAAAQVDNYLSSSSDSQEEDFVKMQQGFTKRPQDLNKKQQHIVMT

SEQ ID NO: 14764 - protein, 2221 aa, Populus trichocarpa
MSAAASSGALLQPKSVKAPFSSLSKSSSLSPSLNVATAASVSRRSARANRCASTRKSVVVERKSFLGSKVRGSAGSERLHFWQSDGPGREPKLRVVVRSALSGVPEKPLGLYDPSFDKDSCGVGFVAELSGDSSRKTVNDALEMLVRMTHRGACGCETNTGDGAGILVALPHDFYKEVAKDIGFELPPPGEYAVGMFFLPTSDNRKEESKNVFTKVAESLGHTVLGWRPVPTDNSGLGNSALQTEPVIEQVFLTATPRSKADFEQQMYILRRVSMVAIRAALNLQYGGVRDFYICSLSSRTVVYKGQLKPEQLKGYYYADLGNERFTSYMALVHSRFSTNTFPSWDRAQPMRVLGHNGEINTLRGNVNWMKAREGLIKCKELGLSKNEMKKLLPIVDASSSDSGAFDGVLELLIRAGRSLPEAVMMMIPEAWQNDKNMDPQRRALYEYFSALMEPWDGPALISFTDGHYLGATLDRNGLRPGRFYVTRSGRVIMASEVGVVDIPPEDVLRKGRLNPGMMLLVDFEKHIIVDDEALKQQYSLARPYGEWLKRQKIELSDIVDSVQESERVAPAISGVVPASDDDTSMQNMGTHGLLAPLKAFGYTVEALEMLMLPMAKDATEALGSMGNDAPLAVMSNREKLTFEYFKQMFAQVTNPPIDPIREKIVTSMECMIGPEGDLTETTEEQCHRLSLKGPLLSIEQMEAMKKMNFSGWRSKVLDITYSKERGRKGLEETLDRICAEAHEAIKEGYTVLVLSDRAFSSKRVAASSLLAVGAVHQYLVKKLERTQVGLIVESAEPREVHHFCTLVGFGADAICPYLAVEAIWRLQVDGKIPPKSTGEFHTKDELVKKYFKASNYGMMKVLAKMGISTLASYKGAQIFEGLGLSSEVIDKCFAGTPSRVEGATFEMLARDSLHLHELAFPSRVLPPGSAEAVALPNPGDYHWRKGGEIHLNDPLAIAKLQEAARGNSVAAYKEYSKRVQELNKACNLRGLLKFKEADVKVSLDEVEPASEIVKRFCTGAMSYGSISLEAHTTLAQAMNKIGGKSNTGEGGEQPSRMETLPDGSMNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEELREIMAQLGFRTMTEMVGRSDMLEVDKEVVKSNEKLENIDLSLLLRPAADIRPEAAQYCVQKQDHGLDMALDNKLIKLSEAALEKGLPVYIETPICNVNRAVGTMLSHEVTKRYHLAGLPADTIHIKLTGSAGQSLGAFLCPGIMLELEGDGNDYVGKGLSGGKIVVYPPKGSLFDPKENIVIGNVALYGATCGEAYFNGMAAERFCVRNSGARAVVEGVGDHGCEYMTGGTVVVLGKTGRNFAAGMSGGVAYVLDLDGKFRSRCNPELVDLDKVEEEEDITTLKMMIQQHQRHTNSLLAREVLADFDNLLPKFIKVFPRDYKRVLANMKEESATKEAADLAAKEVEEAEEQDEAELKEKDAFEELKKLAAASLNGNSIQVEDGPLKRPTRVNDAVKHRGFIAYEREGVQYRDPNIRMNDWKEVTEESKPGPLLKTQSARCMDCGTPFCHQENSGCPLGNKIPEFNELVHQNRWREALDRLLETNNFPEFTGRVCPAPCEGSCVLGIIDDPVSIKNIECSIIDKAFEEGWMVPRPPLKRTGRRVAIVGSGPSGLAAADQLNKMGHLVTVYERADRIGGLMMYGVPNMKTDKVDIVQRRVNLMSEEGINFVVNANVGIDPLYSLDRLRDENNAIVLAVGATKPRQLSGVYFAMQFLHANTKSLLDSNLQDGNYISAKGKKVVVIGGGDTGTDCIGTSIRHGCSSIVNLELLPEPPRTRGPGNPWPQWPRVFRVDYGHQEAAAKFGKDPRSYEVLTKRFIGDENGNVKGLELVRVHWEKDATGKFQFKEVEGSEEVIEADLVLLAMGFLGPELNVAEKLGLEQDNRSNFKAEYGRFSTNVEGIFAAGDCRRGQSLVVWAISEGRQAASQVDKYLMKEEDATINTDNTQDDLVKRHQDLTKRHQDSSKHTVMT

SEQ ID NO: 14765 - protein, 2197 aa, Echinacea purpurea
MSVALNHALQARPDPNLTKSFSTRPVNGLTRIGVKQSSLLGKKLYGTRVGRRVGSVSWSGSETLHKLDGPGRKVVVRAGLSLVPEKPLGLYDPAFDKDSCGVGFVAELSGEGNRKTVTDAIEMLVRMSHRGACGCETNTGDGAGILVGLPHEFFKEVAKDEGFELPPLGQYAVGMFFLPTSDTRREQSKIVFTKVAESLGHTVLGWRTVPTDNSGLGKSALQTEPVIEQVFLTPTSRAKVDFERQMYILRRVSMVAIRAALNLQHGGVKDFYICSLSSRTVVYKGQLKPNQLKEYYHADLGNERFTSYMAMIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPQRKALYEYCSALMEPWDGPALVSFTDGRYLGATLDRNGLRPGRFYVTHSGRVIMASEVGVVDIPPEDVARKGRLNPGMMLLVDFDKHIVVDDEALKQQYSLARPYGKWLETQKIELKKIVESVNKSLRSCPPIAGVSKAEEDMGIQGLLAPLKAFGYTIESLEMLLLPMAKDGVEALGSMGNDAPLAVMSNREKLTFEYFKQMFAQVTNPPIDPIREKIVTSMECMVGPEGDLTETTEEQCHRLSLKGPLLSIEEMESIKNMNYRGWRSKVLDITYPKELGKKGLEETLDRICSQAHDAIKEGYTTLVLSDRAFSSKRVAVSSLLAVGAVHHHLVKKLERTRVALMVESAEPREVHHFCTLVGFGADAICPYLAVEAIWRLQADGKIPPKSNGEFHTKEELVKKYYKASHYGMQKVLAKMGISTLASYKGAQIFEAVGLSTDVMERCFAGTPSRVEGATFEALAGDALNLHDLGFPARKFPPNSAEAVALPNPGDYHWRKGGEIHLNDPLAIAKLQEAARGNSVAAYKEYSKRIHELNKTCNLRGLLKFKEGNAKVPLEEVEPASEIVKRFCTGAMSYGSISLEAHTTLAIAMNKIGGKSNTGEGGENPSRLVSLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPSARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEMREIMADLGFRTVNEMVGRADMLEVDKDLTKDNEKLKNIDLSLLLRPAADIRPDAAQICVQKQDHGLDMALDQRLIPLAKPALEKGLPVYIESPICNVNRAVGTMLSHEVTKRYHLAGLPADTIHIKLNGSAGQSIGAFLCPGILLELEGDSNDYVGKGLSGGKIVVYPPKGSGFDPKENIVIGNVALYGATSGEAYFNGMAAERFCVRNSGANAVVEGVGDHGCEYMTGGTVVILGKTGRNFAAGMSGGIAYVLDVDAKFRLRCNAELVDLDKVEDEDDIMTLRMMIQQHQRYTNSQLAKEVLADFDNLLPKFIKVFPRDYKRILATMKEKENAKNAAAEMAPEEADIREEDELKEKDAFEELKKLAAKALSEAVNINVKEMVNEVKEVEMAEPATRPSRVEDAVKHRGFVAYEREGVSYRDPAVRMEDWNEVMEETKPGPLLKTQSARCMDCGTPFCHQDNSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPAGLAAADQLNRLGHTVTVFERADRIGGLMMYGVPNMKTDKIDVVQRRVDLMAEEGVNFVVNANVGTDPSYSIERLHEENDAVILAVGSTRPRDLPVPGRELSGIHFAMEFLHANTKSLLDSNLEDGNYISAKGKKVIVIGGGDTGTDCIGTSIRHGCTSIVNLELLPQPPQTRAPGNPWPQWPRVFRVDYGHQEAATKFGKDPRTYEVLTKRFISDDNGSVKGVEVVRVQWAKDEAGQFKFKEVEGSEEILEADLVLLAMGFLGPESTIADKLGLEKDGRSNVKAEYGRFSTNVEGVFAAGDCRRGQSLVVWAISEGRQAAAQVDKFLSKDEKDVESRLEKGKREQQAVRTL

SEQ ID NO: 14766 - protein, 2197 aa, Echinacea purpurea
MSVALNHALQARPDPNLTKTFSTRPVNGLTRIGVKQSSLLGKKLYGTRVGRRVGSVSWSGSETLHKLDGPGRKVVVRAGLSLVPEKPLGLYDPAFDKDSCGVGFVAELSGEGNRKTVTDAIEMLVRMSHRGACGCETNTGDGAGILVGLPHEFFKEVAKDEGFELPPPGQYAVGMFFLPTSDTRREQSKIVFTKVAESLGHTVLGWRTVPTDNSGLGKSALQTEPVIEQVFLTPTSRSKVDFERQMYILRRVSMVAIRAALNLQHGGVKDFYICSLSSRTVVYKGQLKPNQLKEYYHADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPQRKALYEYCSALMEPWDGPALVSFTDGRYLGATLDRNGLRPGRFYVTHSGRVIMASEVGVVDIPPEDVARKGRLNPGMMLLVDFDKHIVVDDEALKQQYSLARPYGKWLETQKIELKKIVESVNKSLRSCPPIAGVSKAEEDMGIQGLLAPLKAFGYTIESLEMLLLPMAKDGVEALGSMGNDAPLAVMSNREKLTFEYFKQMFAQVTNPPIDPIREKIVTSMECMVGPEGDLTETTEEQCHRLSLKGPLLSIEEMESIKNMNYRGWRSKVLDITYPKELGKKGLEETLDRICSQAHDAIKEGYTTLVLSDRAFSSKRVAVSSLLAVGAVHHHLVKKLERTRVALMVESAEPREVHHFCTLVGFGADAICPYLAVEAIWRLQADGKIPPKSNGEFHTKEELVKKYYKASHYGMQKVLAKMGISTLASYKGAQIFEAVGISTEVMETCFAGTPSRVEGATFEALAGDALNLHDLGFPARKFPPNSAEAVALPNPGDYHWRKGGEIHLNDPLAIAKLQEAARGNSVAAYKEYSKRIHELNKTCNLRGLLKFKEGNAKVPLEEVEPASEIVKRFCTGAMSYGSISLEAHTTLAIAMNKIGGKSNTGEGGENPSRLVSLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPSARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEMREIMADLGFRTVNEMVGRADMLEVDKDLTKDNEKLGNIDLSLLLRPAADIRPDAAQICVQKQDHGLDMALDQRLIPLAKPALEKGLPVYIESPICNVNRAVGTMLSHEVTKRYHLAGLPADTIHIKLNGSAGQSIGAFLCPGILLELEGDSNDYVGKGLSGGKIVVYPPKGSGFDPKENIVIGNVALYGATSGEAYFNGMAAERFCVRNSGANAVVEGVGDHGCEYMTGGTVVILGKTGRNFAAGMSGGIAYVLDVDAKFRLRCNAELVDLDKVEDEDDIMTLRMMIQQHQRYTNSQLAKEVLADFDNLLPKFIKVFPRDYKRILATMKEKENAKNAAAEMAPEEADIREEDELKEKDAFEELKKLAAKALSEAVNINVKEMVNEVKEVEMAEPATRPSRVEDAVKHRGFVAYEREGVSYRDPAVRMEDWNEVMEETKPGPLLKTQSARCMDCGTPFCHQDNSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPAGLAAADQLNRLGHTVTVFERADRIGGLMMYGVPNMKADKIDVVQRRVDLMAEEGVNFVVNANVGTDPSYSIERLHEENDAVILAVGSTRPRDLPVPGRELSGIHFAMKFLHANTKSLLDSNLEDGNYISAKGKKVIVIGGGDTGTDCIGTSIRHGCTSIVNLELLPQPPQTRAPGNPWPQWPRVFRVDYGHQEAATKFGKDPRTYEVLTKRFVSDDNGSVKGVEVVRVQWAKDETGQFKFKEVEGSEEILEADLVLLAMGFLGPESTIADKLGLEKDGRSNVKAEYGRFSTNVEGVFAAGDCRRGQSLVVWAISEGRQAAAQVDKFLSKDEKDVESRLEKGKREQQAVRTL

SEQ ID NO: 14767 - protein, 2197 aa, Echinacea purpurea
MSVALNHALQARPDPNLTKSFSTRPVNGLTRIGVKQSSLLGKKLYGTRVGRRVGSVSWSGSETLHKLDGPGRKVVVRAGLSLVPEKPLGLYDPAFDKDSCGVGFVAELSGEGNRKTVTDAIEMLVRMSHRGACGCETNTGDGAGILVGLPHEFFKEVAKDEGFELPPLGQYAVGMFFLPTSDTRREQSKIVFTKVAESLGHTVLGWRTVPTDNSGLGKSAVQTEPVIEQVFLTPTSRSKVDFERQMYILRRVSMVAIRAALNLQHGGVKDFYICSLSSRTVVYKGQLKPNQLKEYYHADLGNERFTSYMAMIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPQRKALYEYCSALMEPWDGPALVSFTDGRYLGATLDRNGLRPGRFYVTHSGRVIMASEVGVVDIPPEDVARKGRLNPGMMLLVDFDKHIVVDDEALKQQYSLARPYGKWLETQKIELKKIVESVNKSLRSCPPIAGVSKAEEDMGIQGLLAPLKAFGYTIESLEMLLLPMAKDGVEALGSMGNDAPLAVMSNREKLTFEYFKQMFAQVTNPPIDPIREKIVTSMECMVGPEGDLTETTEEQCHRLSLKGPLLSIEEMESIKNMNYRGWRSKVLDITYPKELGKKGLEETLDRICSQAHDAIKEGYTTLVLSDRAFSSKRVAVSSLLAVGAVHHHLVKKLERTRVALMVESAEPREVHHFCTLVGFGADAICPYLAVEAIWRLQADGKIPPKSNGEFHTKEELVKKYYKASHYGMQKVLAKMGISTLASYKGAQIFEAVGLSTEVMERCFAGTPSRVEGATFEALAGDALNLHDLGFPARKFPPNSAEAVALPNPGDYHWRKGGEIHLNDPLAIAKLQEAARGNSVAAYKEYSKRIHELNKTCNLRGLLKFKEGNAKVPLEEVEPASEIVKRFCTGAMSYGSISLEAHTTLAIAMNKIGGKSNTGEGGENPSRLVSLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPSARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEMREIMADLGFRTVNEMVGRADMLEVDKDLTKDNEKLGNIDLSLLLRPAADIRPDAAQICVQKQDHGLDMALDQRLIPLAKPALEKGLPVYIESPICNVNRAVGTMLSHEVTKRYHLAGLPADTIHIKLNGSAGQSIGAFLCPGILLELEGDSNDYVGKGLSGGKIVVYPPKGSGFDPKENIVIGNVALYGATSGEAYFNGMAAERFCVRNSGANAVVEGVGDHGCEYMTGGTVVILGKTGRNFAAGMSGGIAYVLDVDAKFRLRCNAELVDLDKVEDEDDIMTLRMMIQQHQRYTNSQLAKEVLADFDNLLPKFIKVFPRDYKRILATMKEKENAKNAAAEMAPEEADIREEDELKEKDAFEELKKLAAKALSEAVNINVKEMVNEVKEVEMAEPATRPSRVEDAVKHRGFVAYEREGVSYRDPAVRMEDWNEVMEETKPGPLLKTQSARCMDCGTPFCHQDNSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPAGLAAADQLNRLGHTVTVFERADRIGGLMMYGVPNMKADKIDVVQRRVDLMAEEGVNFVVNANVGTDPSYSIERLHEENDAVILAVGSTRPRDLPVPGRELSGIHFAMKFLHANTKSLLDSNLEDGNYISAKGKKVIVIGGGDTGTDCIGTSIRHGCTSIVNLELLPQPPQTRAPGNPWPQWPRVFRVDYGHQEAATKFGKDPRTYEVLTKRFVSDDNGSVKGVEVVRVQWAKDEAGQFKFKEVEGSEEILEADLVLLAMGFLGPESTIADKLGLEKDGRSNVKAEYGRFSTNVEGVFAAGDCRRGQSLVVWAISEGRQAAAQVDKFLSKDEKDVESRLEKGKREQQAVRTL

SEQ ID NO: 14768 - protein, 2117 aa, Plantago ovata
MATKGGMSQVPEKPLGLYDPAFDKDSCGVGFVAELSGESSRKTVTDAVEMLVRMTHRGACGCETNTGDGAGILVGLPHHFYAQVAKDAGFELPGPGEYAIGMFFLPTSDTRREQSKSVFKKVAESLGHTVLGWRPVPTDNSGLGKSALDTEPIIEQVFLSATSRSTADIEQQMYILRRVAMVAIRAALNMQHGGAKDFYICSLSSRTVVYKGQLKPDQLKDYYYADLGNERFTSYMALVHSRFSTNTFPSWDRAQPMRVLGHNGEINTLRGNVNWMKAREGLLKCSELGLSKAEMKKLLPIVDASSSDSGAFDGVLELLIRAGRSLPEAVMMMIPEAWQNDKNMDPERKALYEYFSALMEPWDGPALISFTDGRYLGATLDRNGLRPGRFYVTHSGRVVMASEVGVVDIPPEDVSRKGRLNPGMMLLVDFENHVVVDDDALKQQYSQARPYGEWLERQKIQLKDIVESVQESDRMAPLIAGVMQGSVDDENMENMGLHGLLSPLKAFGYTVESLEMLLLPMAKDGVEALGSMGNDAPLAVMSNREKLTFEYFKQMFAQVTNPPIDPIREKIVTSMECMIGPEGDLTETTEEQCHRLSLKGPLLSIEEMEAVKKMNYRGWRSKVLDITYSKSRGRKGLEETLDRICSEAHEAIKDGYTTLVLSDRAFSPKRVPVSSLLAVGAVHHHLVNNLERTRVALIVESAEPREVHHFCTLVGFGADAICPYLAVEAIWRLQVDGKIPPKSTGEFHSKGELVKKYFKATTYGMMKVLAKMGISTLASYKGAQIFEAVGLSSEVMSRCFAGTPSRVEGATFEALAIDALQLHEMAFPTRALPPGSAEAVALPNPGDYHWRKGGEVHLNDPLAIAKLQEAARTNSVAAYKEYSKRVQELNKSCNLRGLLKFKETDVGVPLEEVEPASEIVKRFCTGAMSYGSISLEAHTTLALAMNKIGGKSNTGEGGEQPSRMEPLSDGSRNPKRSSIKQVASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTLTEMVGRSDMLELDRDVAQNNEKLKNIDLSLLLRPAADIRPDAAQVCVQKQDHGLDIALDNKLIDLAKPALDKSFPVYIESPICNVNRAVGTMLSHEVTKRFHMEGLPSDTIHIKLNGSAGQSLGAFLCPGITLELEGDSNDYVGKGLSGGRIIVYPPKQSNFDPKENIVIGNVALYGSTKGEAYFNGMAAERFAVRNSGARAVVEGVGDHGCEYMTGGTVVVLGNTGRNFAAGMSGGVAYVLDVNSTFRSRCNTELVDLDPVEEEDDIMTLRMMIQQHQRHTGSQLAKEVLADFESLLPKFIKVFPRDYKRVLASMKADEISKAVEAENAAKDERNEEAELKEKDAFEELKKLAATSLNGQQSQIEEDKSEKRPTRVSDAVKHRGFVAYEREGVSYRDPTVRMNDWNEVMEEAKPGPLLKTQSARCMDCGTPFCHQENSGCPLGNKIPEFNELVYQNRWREALDRLLETNNFPEFTGRVCPAPCEGSCVLGIIENPVSIKNIECSIIDKAFEEGWMVPRPPLKRTGKRVAIIGSGPAGLAAADQLNKKGHLVTVFERADRIGGLMMYGVPNMKADKIDVVQRRVDLMEKEGVNFVTNANIGKDLSYSLENLRKEHDAIVLAVGATKPRDLPVPGRELSGVHFAMEFLHANTKSLLDSKLEDGNYISANGKRVVVIGGGDTGTDCIGTSIRHGCSSVVNLELLPIPPQTRAPGNPWPQWPRVFRVDYGHQEAATKFGKDPRTYEVLTKRFIGGENGAVKGLEVVRVKWEKDASGRFQFKEIEGSEEIIEADLVLLAMGFLGPESTLAEKLGLEQDNRSNFKAEYGRFSTNVEGIFAAGDCRRGQSLVVWAISEGRQSAAQVDKYLMKDEETSDTRQGELVEDRRTVMT

SEQ ID NO: 14769 - protein, 2228 aa, Populus trichocarpa
MSAAASSSSAILQPKSVKSSISSLNKSSSCVFSPSLNVATAASISRRRGRATRCVSARNSAVVERKSFLGSKVRGSPSERLHFWLSEGPGREPKLRVVVRSALSGVPEKPLGLYDPSFDKDSCGVGFVAELSGENSRKTVNDALEMSVRMAHRGACGCETNTGDGAGILVALPHDYYKEVAKDIGFELPPSGEYAVGMFFLPTSDNRREESKNVFTKVAESLGHTVLGWRPVPTDNSALGNAALQTEPVIEQVFLTATPRSKADFEKQMYILRRVSMVAITAALNLQYGGVKDFYICSLSSRTVVYKGQLKPDQLKAYYYADLGNETFTSYMAMVHSRFSTNTFPSWDRAQPMRVLGHNGEINTLRGNVNWMKAREGLLKCKELGLSKNEMKKILPIVDASSSDSGAFDGVLELLIRSGRTLPEAVMMMIPEAWQNDKNMDPQRRALYEYSSALMEPWDGPALISFTDGHYLGATLDRNGLRPGRFYVTRSGRVIMASEVGVVDIPPEDVLRKGRLNPGMMLLVDFEKHTVVDDEALKQQYSLARPYGEWLKRQKIELSDIVNSVQESDKVAPAISGVVAASDDDDSMVHMGIHGLLAPLKSFGYTVEALEMLMLPMAKDGTEPLGSMGNDAPLAVMSNREKLTFEYFKQMFAQVTNPPIDPIREKIVTSMECMIGPEGDLTETTEEQCRRLSLKGPLLSIGEMEAIKKMNYNGWRSKVLDITYSIKRGRKGLEETLDRICTEAHEAIKEGYTVLVLSDRAFSSKRVAVSSLLAVGAVHQYLVKKLERTQVGLIVESAEPREVHHFCTLVGFGADAICPYLAIDAIWRLQVDGKIPPKSTGELHSKDELVKKYFKASNYGMMKVLAKMGISTLASYKGAQIFEGLGLSSEVIDKCFAGTPSRVEGATFEMLANDSLRLHELAFPSRALPPGSAEAVALPNPGDYHWRKGGEIHLNDPLAIAKLQEAARGNSVAAYKEYSKRIQELNKACNLRGLLKFKVADVKVSLDEVEPASEIVKRFCTGAMSYGSISLEAHTTLAQAMNKIGGKSNTGEGGEQPSRMEPLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPSARISVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLRDKFAGEPEHVINFFFMLAEELREIMAQLGFRTMNEMVGRSDMLEVDKEVVKSNEKLENIDLSSLLRPAADIRPGAAQYCVQKQDHGLDMALDQKLIKLSEAALEKSLPVYIETPIRNVNRAVGTMLSHEVTKRYHLAGLPADTIHIKLKGSAGQSLGAFLCPGIMLELEGDGNDYVGKGLSGGKIVVYPPKGSLFDPKENIIIGNVALYGATGGEAYLNGMAAERFCVRNSGARAVVEGIGDHGCEYMTGGTIVVLGKTGRNFAAGMSGGVAYVLDLDGKFKSRCNLELVDLDKVEEEEDIMTLKMMIQQHQRHTNSLLAREVLADFDNLLPKFIKVFPRDYKRVLANMKEESASKEAAELAAKEAEEKNEAELREKDAFEELKKMAAASLNGKSNQVVEDEPLKRPTRVNNAVKHRGFIAYEREGVQYRDPNVRMNDWKEVMESSKPGPLLNTQSARCMDCGTPFCHQENSGCPLGNKIPEFNELVHQNRWREALDRLLETNNFPEFTGRVCPAPCEGSCVLGIIDDPVSIKNIECSIIDKAFEEGWMVPRPPLKRTGKRVAIVGSGPSGLAAADQLNKRGHLVTVYERADRIGGLMMYGVPNMKTDKVDIVQRRVNLMAKEGINFVVNANVGIDPLYSLDQLRQENDAIVLAVGATKPRDLPVPGREMSGVHFAMEFLHKNTKSLLDSNLQDGNYISAKGKKVVVIGGGDTGTDCMGTSIRHGCSGVVNLELLPEPPQTRAPGNPWPQWPKVFRVDYGHQEAASKFGKDPRSYEVLTKRFIGDEDGSVKGLEVVRVHWEKDASGKFQYKEVEGSEEIIEADLVLLAMGFLGPEPNVAKKLGLEQDNRSNFKAEYGRFSTNVEGIFAAGDCRRGQSLVVWAISEGRQAASQVDKYLMKEEDVTISTDNTQDELVKRHKDLTKRHQDSSKHTVMT

SEQ ID NO: 14770 - protein, 2208 aa, Malus domestica
MLASTGGSVVQLRAKSSLLPSQLNATPVARLGGSRAAVTTCSASRKSSKALAKKFFGTRLRASGSERLHLWRSDGPGRSPKLRVVVRNMLSAVPEKPLGLYDPSFDKDSCGVGFVAELSGEVSRKTITDAIEMLERMTHRGACGCETNTGDGAGILVGVPHDFYKEVTKDAGFDLPPAGEYAVGMFFLPASESRREESKRVFAKVAESLGHTVLGWRSVPTDNSDLGKSALQTEPVIEQVFLTATPRSKLDLERQMYILRRLSMVAIRAALNLELGGAKDFYICSLSSRTVVYKGQLKPIQLKDYYYADLGNERFTSYMALVHSRFSTNTFPSWDRAQPMRIIGHNGEINTLRGNVNWMKAREGLLKCKELGLSENDLKKLLPIVDASSSDSGAFDGVLELLVQAGRSLPEAIMMLIPEAWQNDKNMDPDRKALYEYFSSLMEPWDGPALISFTDGRYLGATLDRNGLRPGRFYVTHSGRVIMASEVGVVDIPPEDVSRKGRLNPGMMLLVDFENHVVVDDEALKQQYSLARPYGEWLQRQKIELKDIVDSVHESDRVPPSIAGAIPASTDDETMENMGIHGLLAPLKAFGYTVESLEMLLLPMAKDGVEALGSMGNDTPLAVMSNREKLTFEYFKQMFAQVTNPPIDPIREKVVTSMECMIGPEGDLTETTEEQCHRLSLKGPLLTIDEMEAIKQMNYRGWRCKVLDITYSKKRGREGLEETLDRICAEAREAIKKGYTTLVLSDRAFSPKRVAVSSLLAVGAVHQHLVKNLERTQVGLIIESAEPREVHHFCTLVGFGADAICPYLAIEAIWRLQVDGKIPPKANGAIYSKDELVKKYFKASNYGMMKVLAKMGISTLASYKGAQIFEALGLSSEVVERCFAGTPSRVEGATFEMLARDELHMHELAFPSRSYPPGSAEAVALPNPGDYHWRKGGEVHLNDPFAIAKLQEAARTNSVAAYKEYSKFIHELNKACNLRGLLKFKNTEQQIHLDEVEPASEIVKRFCTGAMSYGSISLEAHSTLAIAMNRIGGKSNTGEGGEQPSRMEPLSDGSRNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGVVASGVVKGHADHVLISGHDGGTGASRWTGIKNAGLPWELGLAETHQTLVANDLRGRTTLQTDGQLKTGRDVAIAALLGAEEFGFSTAPLITLGCIMMRKCHKNTCPVGIATQDPVLREKFAGEPEHVINFFFMIAEELREIMAQLGFRTINEMVGRSDMLEVDREVTKNNEKLDNIDLSLLLRPAADLRPGAAQYCVEKQDHGLDMALDHKLIAMSKAALEKALPVYFETPICNVNRAVGTMLSHEVTKRYNRAGLPADTIHIKFSGSAGQSLGAFLCPGIMLELEGDSNDYVGKGLSGGKIVVYPPKGSKFDPKENIVIGNVALYGATSGEAYFNGMAAERFCVRNSGAKAVVEGVGDHGCEYMTGGTVVVLGKTGRNFAAGMSGGIAYVYDVDGQFRSRCNPELVDLDRLEEEDILTLQMMIQQHQRHTNSLLAIEVLADFENLLPKFIKVIPREYKRVLADMKEETKQVIEHEEEDEPELEEKDAFEELKKLAAASLNGKSNQVEDAEALKRPSQVTDAVKHRGFISYEREGVQYRDPNVRMNDWKEVMEETKPGPLVKTQSARCMDCGTPFCHQENTGCPLGNKIPEFNELVYQNRWHEALERLLETNNFPEFTGRVCPAPCEGSCVLGIIENPVSIKSIECAIIDKAFEEGWMVPRPPVKRTGKRVAIVGSGPAGLAAADQLNRIGHTVTVYERADRIGGLMMYGVPNMKTDKVEIVQRRVNLMTEEGVNFVVNANIGNDPLYSLERLREENNAIVLAVGATKPRDLPVPGRELSGVHFAMEFLRANTKSLLDSNLEDGNYISAKGKKVVVIGGGDTGTDCIGTSVRHGCTSIINLELLPEPPRTRAPGNPWPQWPRVFRVDYGHQEVAAKFGKDPRTYEVLTKRFVGDENGAVKGLEVVRVKWEKDETGRFQFKEIEGSEEILEADLVLLAMGFLGPEATVAEKLGLERDQRSNYKADYGRFSTNVDGVFAAGDCRRGQSLVVWAISEGRQAAAQVDKYLSNEEEDRTISNGSHPDLSKRHQDLSKRNPTGSSKHTVMT

SEQ ID NO: 14771 - protein, 2211 aa, Eutrema halophilum
MSAASSSSVLHLRNNQLLPIRSLKNPTVVASQLAVAPGVGRRRACTARCSVKKPAAPESPFLGTRMRRSGSETLQFWRSDGPGRSPKLKTVVRSSFSGVPEKPLGLYDPSFDKDSCGVGFVAELSGETSRKTVTDSLEMLIRMTHRGACGCESNTGDGAGILVGLPHEFYAEATKELGFVLPPAGKYAVGMFFLPKAESRRNESKNVFTKVAESLGHSVIGWRPVPTDNSGLGKSALQTEPIIEQVFLTPTTKSKADLEQQMYILRRVSMVAIRAALNLEHGAMKDFYICSLSSRTVVYKGQLKPDQLKDYYYADLGSERFTSYMALVHSRFSTNTFPSWDRAQPMRVLGHNGEINTLRGNVNWMRAREGLLKCKELGLSKNELKKLLPIVDVSSSDSGAFDGVLELLVRAGRSLPEAVMMMIPEAWQNDKNIDPSRKAFYEYLSALMEPWDGPALISFTDGRYLGATLDRNGLRPGRFYITHSGRVIMASEVGVVDVPPEDVMRKGRLNPGMMLLVDFEKHIVVDDDALKQQYSQARPYGEWLERQKIELKDIIKSVPESERIASPISGVVPASDDDDSMESMGIHGLLSPLKAFGYTVEALEMLLLPMAKDGTEALGSMGNDTPLAVMSNREKLCFEYFKQMFAQVTNPPIDPIREKIVTSMECMIGPEGDLTETTEEQCHRLSLKGPLLTIEEMESIKKMNYRGWRTKVLDITYQKDQGTKGLEKTLDRICDEANEAIKEGYTLLVLSDRAFSATRVAVSSLLAVGAVHHHLVKTLARTQVGLVVESAEPREVHHFCTLVGFGADAICPYLAVEAVFRLQVDGKIPPKSNGEFHSKEELVKKYYKASNYGMMKVLAKMGISTLASYKGAQIFEALGLSSEVIEKCFAGTPSRVEGATFEMLARDALLLHEMAFPARGYAPGSAEASALSNPGNYHWRKNGEIHLNDPLAIAKLQEAARTNSVAAYKEYSKRINELNKQSNLRGFMKFKEADVKIPLDEVEPASEIVKRFCTGAMSYGSISLEAHTTLAMAMNKLGGKSNTGEGGELPSRMEPLPDGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTLTEMIGRADMLELDREVVKNNDKLENIDLSLLLKPAAEIRPGAAQYCVQKQDHGLDMALDQELIALSKSALEKSLPVYIETPICNVNRAVGTMLSHEVTKRYHLAGLPKDTIHIKFKGSAGQSLGAFLCPGITLELEGDSNDYVGKGLSGGKVVVYPPKGSSFDPKENIVIGNVALYGATSGEAYFNGMAAERFSVRNSGAKAVVEGVGDHGCEYMTGGTVVVLGKTGRNFAAGMSGGIAYVLDVDGKFHTRCNLELVDLDKVEDEDDKMTLKMMIQQHQRHTDSQLAQEVLADFENLVPKFVKVFPRDYKRVLSAMKHEEVSNQAIERASEEADEMEEKELEEKDAFTELKNMAAASSKEEMSGNGVAAEAPKKPSLVNDAVKHRGFIAYEREGVKYRDPNVRLHDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFDEGWMVPRPPLKRTGRKVAIIGSGPAGLAAADQLNKMGHSVTVYERADRIGGLMMYGVPNMKTDKIDIVQRRVDLMTKEGINFVVNANIGKDPSFSLDGLKEENDAIVLAVGSTKPRDLPVSGRELSGVHFAMEFLHANTKSLLDSNLEDGNYISAKGKKVVVIGGGDTGTDCIGTSIRHGCTNIVNLELLPQPPSTRAPGNPWPQWPRVFRIDYGHQEAATKFGKDPRTYEVLTKRFIGDDNGNVKGLEIVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAASQVDKYLSKTDDDQADAKLRQSLNQMKHNDTRTS

SEQ ID NO: 14772 - protein, 2207 aa, Arabidopsis lyrata
MSAASSSSVLNLRTNQQLLSLRSLKNSTSVASQLAVTSGVSRRRSCTARCSVKKPVAPESPFLGTRVRRSGSETLQFWRSDGPGRSAKLRTVVKSSFSGVPEKPLGLYDPSYDKDSCGVGFVAELSGETSRKTVTDSLEMLIRMTHRGACGCESNTGDGAGILVGLPHDFYAEAATELGFVLPPAGKYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPAAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRRYAPGSAEASALTNPGNYHWRKNGEIHLNDPLAIAKLQEAARTNSVAAYKEYSKRINELNKQSNLRGLMKFKDADVKISLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLAGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGVGDHGCEYMTGGTVVVLGKTGRNFAAGMSGGIAYVLDVDGKFHTRCNLELVDLDKVEDEEDKMSLKMMIQQHQRHTNSQLAQEVLADFENLLPKFIKVFPRDYKRVLSAMKHEEVSKQAIERASEEADEMEEKELEEKDAFAELKNMAAASSKEVSGNGVAAEAKPSQVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHSVTVYERSDRIGGLMMYGVPNMKTDKIDVVQRRVDLMTKEGINFVVNANIGKDPSYSLDGLKEESDALILAVGSTKPRDLPVPGRDLSGVHFAMEFLHANTKSLLDSNLEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLEIVRVSWEKDDTGRFQFKEIEGSEEIIEADLVFLAMGFLGPEPTLAEKLGLECDNRSNFKAEYGRFSTTVEGVFAAGDCRRGQSLVVWAISEGRQAAAQVDKFLSKTDDDEDAKLQQDLNQMKHNTITN

SEQ ID NO: 14773 - protein, 2207 aa, Prunus persica
MLASSGSVVQLRTKPSLASQLNATPIARLGSRAAACSATRKSTKALANKFFGTRLRPAGSEKLHIWRSDGPGRSPKLRVVVRSLLSAVPEKPLGLYDPSFDKDSCGVGFVAELSGEGSRKTITDALEMLVRMAHRGACGCETNTGDGAGILVGLPHDFYKEVAKDVGFKLPPAGEYAVGMFFLPTSDSRREESKNVFTKVAESLGHTVLGWRSVPTDNSDLGKSALQTEPVIEQVFLTPTPRSKLDLERQMYILRRVSMVAIRAALNLEHGGAKDFYICSLSSRTVVYKGQLKPIQLKDYYFADLGNERFTSYMALVHSRFSTNTFPSWDRAQPMRVIGHNGEINTLKGNVNWMKAREGLLKCKELGLSRNELKKLLPIVDASSSDSGAFDGVLEFLVQAGRSLPEAMMMMIPEAWQNDKNMDPHRKALYEYFSSLMEPWDGPALISFTDGRYLGATLDRNGLRPGRFYVTHSGRVIMASEVGVVDIPPEDVSRKGRLNPGMMLLVDFENHIVVDDEALKQQYSLARPYGEWLERQKIELKDIVASVQESDRAPPSIAGVIPASTDDENMENMGIHGLLAPLKAFGYTLESLEMLLLPMAKDGVEALGSMGNDTPLAVMSNREKLTFEYFKQMFAQVTNPPIDPIREKVVTSMECMIGPEGDLTETTEEQCHRLSLKGSLLTIEEMEAIKKMNYRGWRCKVLDITYSKERGREGLEETLDRICAEAREAIKKGYTTLVLSDRAFSPKRVAVSSLLAVGAVHQHLVKNLERTRVGLIIESAEPREVHHFCTLVGFGADAICPYLAIEAIWRLQVDGKIPPKANGVIYSKDELVKKYFKASNYGMMKVLAKMGISTLASYKGAQIFEALGLSSEVIERCFAGTPSRVEGATFEMLAHDELHMHELAFPSRTFPPGSAEAVALPNPGDYHWRKGGEVHLNDPFAISKLQEAARTNSVAAYKEYSKFIHELNKACNLRGLLKFKSTEQKIHLDEVEPASEIVKRFCTGAMSYGSISLEAHTTLAMAMNKIGGKSNTGEGGEQPSRMEPLPDGSRNPKRSAIKQVASGRFGVSSYYLTNADELQIKMAQGAKPGEGGELPGHKVIGDIAVTRNSTAGVGLISPPPHHDIYSIEDLAQLIHDLKNANPTARISVKLVSEVGVGVVASGVVKGHADHVLISGHDGGTGASRWTGIKNAGLPWELGLAETHQTLVANDLRGRTTLQTDGQLKTGRDVAIAALLGAEEFGFSTAPLITLGCIMMRKCHKNTCPVGIATQDPVLREKFAGEPEHVINFFFMVAEELREIMSQLGFRTLNEMVGRSDMLEVDKDVTRNNEKLDNIDLSLLLRPAADLRPDAAQYCVQKQDHGLDMALDHKLISLSKAAIEKSLPVYFETTICNVNRAVGTMLSHEVTKLYNREGLPADTIHIKFNGSAGQSLGAFLCPGIMLELEGDSNDYVGKGLSGGKIVVYPPKKSKFDPKENIVIGNVALYGATSGEAYFNGMAAERFCVRNSGARAVVEGVGDHGCEYMTGGTVVVLGKTGRNFAAGMSGGIAYILDVDGQFRSRCNLELVDLDKLEEEDVMTLKMMIQQHQRHTNSLLASQVLADFGNLLPKFIKVIPREYKRVLANMKDEASKQDAADEAEQDEPELIEKDAFEELKKLAASSSLNGKSNQTVEDSEIFKRPSQVSDAVKHRGFISYEREGVQYRDPNVRMNDWKEVMEETQPGPLLKTQSARCMDCGTPFCHQENSGCPLGNKIPEFNELVYQNRWHEALERLLETNNFPEFTGRVCPAPCEGSCVLGIIENPVSIKSIECAIIDKAFEEGWMVPRPPLKRTGKRVAIVGSGPAGLAAADQLNRLGHTVTVYERADRIGGLMMYGVPNMKADKVDIVQRRVNLMAEEGVNFVVNASVGNDPLYSLDRLREENNAIILAVGATKPRDLPVPGRELSGVHFAMEFLHANTKSLLDSNLQDGNYISAKGKKVVVIGGGDTGTDCIGTSVRHGCSSIINLELLPQPPRTRAPGNPWPQWPRVFRVDYGHQEVAAKFGKDPRSYEVLTKRFVGDENGAVKGLELVSVKWEKDATGKFQFKEIEGSEEIIEVDLVLLAMGFLGPEATVAEKLGLERDNRSNYKAEYGRFSTNVDGVFAAGDCRRGQSLVVWAISEGRQAAAQVDKYLSIEEEDDHTISNGSHENILKRHQDLSKRNTGSSKHTVMT

SEQ ID NO: 14774 - protein, 2209 aa, Eutrema parvulum
MSAASSSSVLQLRNNQLFPVRSLKKNPTAVSQLAVAPGVSRRRACTARCSVSKPAAPEKPFMGTRMRRSGSETLQFWRSDGPGRSPKLKTVVKSSFSGVPEKPLGLYDPSFDKDSCGVGFVAELSGDTSRKTVTDSLEMLIRMTHRGACGCESNTGDGAGILVGMPHEFYAEAAKELGFVLPPAGKYAVGMFFLPTAESRRDESKNVFTKVAESLGHSVIGWRSVPTDNSGLGKSALQTEPIMEQVFLTPTTKSKVDLEQQMYILRRVSMVAIRAALNLEHGAMKDFYICSLSSRTVVYKGQLKPDQLKDYYYADLGSERFTSYMALVHSRFSTNTFPSWDRAQPMRVLGHNGEINTLRGNVNWMRAREGLLKCKELGLSKKELKKLLPIVDVSSSDSGAFDGVLELLVRAGRSLPEAVMMMIPEAWQNDKNIDPSRKSFYEYLSALMEPWDGPALISFTDGRYLGATLDRNGLRPGRFYITHSGRVIMASEVGVVDVPPEDVMRKGRLNPGMMLLVDFEKHIVVDDDALKQQYSQARPYGEWLKRQKIELKDIIKSVPETERIAPLISGVALASNNDDSMDSMGIHGLLSPLKAFGYTVEALEMLLLPMAKDGSEALGSMGNDAPLAVMSNREKLCFEYFKQMFAQVTNPPIDPIREKIVTSMECMIGPEGDLTETSEEQCHRLSLKGPLLTIEEMEAIKKMNYRGWRTKVLDITYPKEQGTKGLETTLDRICAEANEAIKEGYTLLVLSDRAFSSTRVAVSSLLAIGAVHHHLVKTLARTQVGLVVESAEPREVHHFCTLVGFGADAICPYLAVEAVHRLQVDGKIPPKSNGEFHSKEELVKKYYKASNYGMMKVLAKMGISTLASYKGAQIFEALGLSSEVIEKCFAGTPSRVEGATFEMLARDALLLHEMAFPARGFAPGSAEASALSNPGNYHWRKNGEIHLNDPLAIAKLQEAARTNSVAAYKEYSKRINELNKQSNLRGLMKFKEADVKIPLDEVEPASEIVKRFCTGAMSYGSISLEAHTTLAMAMNKLGGKSNTGEGGELPSRMEPLPDGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTLTEMIGRADMLELDREVVKNNDKLENIDLSLLLRPAAEIRPGAAQYCVQKQDHGLDMALDQELIALSKSALDKSLPVYIETPICNVNRAVGTMLSHEVTKRYHLAGLPKDTIHIKFSGSAGQSLGAFLCPGITLELEGDSNDYVGKGLSGGKVVVYPPTGSSFDPKENIVIGNVALYGATSGEAYFNGMAAERFSVRNSGAKAVVEGVGDHGCEYMTGGTVVVLGKTGRNFAAGMSGGIAYVLDVDGKFHTRCNHELVDLDKVEDDDDKMTLKMMIQQHQRHTNSQLAQEVLADFENLLPKFVKVFPRDYKRVLSAMKHEEVSKQAIERASEEADEMEEKELEEKDAFAELKNMAATSSKEVMSGNGVAAEAPTKPSKVDDAVKHRGFIAYEREGVKYRDPNVRLNDWNEVMEESKPGPLLKTQSARCMDCGTPFCHQENSGCPLGNKIPEFNELVYQNRWQEALNRLLETNNFPEFTGRVCPAPCEGSCVLGIIENPVSIKSIECAIIDKAFDEGWMVPRPPLKRTGKKVAIIGSGPAGLAAADQLNKMGHLVTVYERSDRIGGLMMYGVPNMKTDKIDIVQRRVDLMTKEGINFVVNANIGKDPSYSLDGLKEENDAIVLAVGSTKPRDLPVPGRELSGVHFAMEFLHANTKSLLDSNLQDGNYISAKGKKVVVIGGGDTGTDCIGTSIRHGCTNIVNLELLPQPPSTRAPGNPWPQWPRVFRIDYGHQEAATKFGKDPRTYEVLTKRFIGDDNGNVKGLEIVRLSWEKDETGRFQFKEIEGSEEIIEADLVFLAMGFLGPEPTLAEKLGLECDNRSNFKAEYGRFSTTVEGVFAAGDCRRGQSLVVWAISEGRQAASQVDKFLSKNEDDLVDAKVGQNLMKHDNSRKT

SEQ ID NO: 14775 - protein, 2209 aa, Eutrema parvulum
MSAASSSSVLQLRNNQLFPVRSLKKNPTAVSQLAVAPGVSRRRACTARCSVSKPAAPEKPFMGTRMRRSGSETLQFWRSDGPGRSPKLKTVVKSSFSGVPEKPLGLYDPSFDKDSCGVGFVAELSGDTSRKTVTDSLEMLIRMTHRGACGCESNTGDGAGILVGMPHEFYAEAAKELGFVLPPAGKYAVGMFFLPTAESRRDESKNVFTKVAESLGHSVIGWRSVPTDNSGLGKSALQTEPIMEQVFLTPTTKSKVDLEQQMYILRRVSMVAIRAALNLEHGAMKDFYICSLSSRTVVYKGQLKPDQLKDYYYADLGSERFTSYMALVHSRFSTNTFPSWDRAQPMRVLGHNGEINTLRGNVNWMRAREGLLKCKELGLSKKELKKLLPIVDVSSSDSGAFDGVLELLVRAGRSLPEAVMMMIPEAWQNDKNIDPSRKSFYEYLSALMEPWDGPALISFTDGRYLGATLDRNGLRPGRFYITHSGRVIMASEVGVVDVPPEDVMRKGRLNPGMMLLVDFEKHIVVDDDALKQQYSQARPYGEWLKRQKIELKDIIKSVPETERIAPLISGVALASNNDDSMDSMGIHGLLSPLKAFGYTVEALEMLLLPMAKDGSEALGSMGNDAPLAVMSNREKLCFEYFKQMFAQVTNPPIDPIREKIVTSMECMIGPEGDLTETSEEQCHRLSLKGPLLTIEEMEAIKKMNYRGWRTKVLDITYPKEQGTKGLETTLDRICAEANEAIKEGYTLLVLSDRAFSSTRVAVSSLLAIGAVHHHLVKTLARTQVGLVVESAEPREVHHFCTLVGFGADAICPYLAVEAVHRLQVDGKIPPKSNGEFHSKEELVKKYYKASNYGMMKVLAKMGISTLASYKGAQIFEALGLSSEVIEKCFAGTPSRVEGATFEMLARDALLLHEMAFPARGFAPGSAEASALSNPGNYHWRKNGEIHLNDPLAIAKLQEAARTNSVAAYKEYSKRINELNKQSNLRGLMKFKEADVKIPLDEVEPASEIVKRFCTGAMSYGSISLEAHTTLAMAMNKLGGKSNTGEGGELPSRMEPLPDGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTLTEMIGRADMLELDREVVKNNDKLENIDLSLLLRPAAEIRPGAAQYCVQKQDHGLDMALDQELIALSKSALDKSLPVYIETPICNVNRAVGTMLSHEVTKRYHLAGLPKDTIHIKFSGSAGQSLGAFLCPGITLELEGDSNDYVGKGLSGGKVVVYPPTGSSFDPKENIVIGNVALYGATSGEAYFNGMAAERFSVRNSGAKAVVEGVGDHGCEYMTGGTVVVLGKTGRNFAAGMSGGIAYVLDVDGKFHTRCNHELVDLDKVEDDDDKMTLKMMIQQHQRHTNSQLAQEVLADFENLLPKFVKVFPRDYKRVLSAMKHEEVSKQAIERASEEADEMEEKELEEKDAFAELKNMAATSSKEVMSGNGVAAEAPTKPSKVDDAVKHRGFIAYEREGVKYRDPNVRLNDWNEVMEESKPGPLLKTQSARCMDCGTPFCHQENSGCPLGNKIPEFNELVYQNRWQEALNRLLETNNFPEFTGRVCPAPCEGSCVLGIIENPVSIKSIECAIIDKAFDEGWMVPRPPLKRTGKKVAIIGSGPAGLAAADQLNKMGHLVTVYERSDRIGGLMMYGVPNMKTDKIDIVQRRVDLMTKEGINFVVNANIGKDPSYSLDGLKEENDAIVLAVGSTKPRDLPVPGRELSGVHFAMEFLHANTKSLLDSNLQDGNYISAKGKKVVVIGGGDTGTDCIGTSIRHGCTNIVNLELLPQPPSTRAPGNPWPQWPRVFRIDYGHQEAATKFGKDPRTYEVLTKRFIGDDNGNVKGLEIVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAASQVDKYLSKNEDDLVDAKVGQNLMKHDNSRKT

SEQ ID NO: 14776 - protein, 2208 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 14777 - protein, 2218 aa, Eucalyptus grandis
MSSASSSSLLQPKTGPHALPTSLARPSITPQLSVSRYRDRAKVASRCSVSKQSTGVLQKNFFGPRLRETGSERLRALASDGSSKLRLLVRSALSAVPEKPLGLYDPRFDKDSCGVGFVAELSGESSRKTVTDAVEMLIRMSHRGACGCETNTGDGAGILVALPHEFYQEVVRENGFKLPPPGEYAVGMLFLPTSDTRREQSKKVFQKVAESLGHVVIGWRSVPTNNSGLGKSALETEPVIEQVFLTPSSRSKVDLERQMYILRRVSMVAIRAALNLQHGSARDFYICSLSSRTVVYKGQLKPVQLKDYYYADLGDERFTSYMALIHSRFSTNTFPSWDRAQPMRILGHNGEINTLRGNVNWMKAREGLLKCKELGLSKNELKKLLPIVDASSSDSGAFDGVLELLVRAGRSLPEAVMMMIPEAWQNDKNMDPQRKALYEYFSALMEPWDGPALISFTDGRYLGATLDRNGLRPGRFYVTHSGRVIMASEVGVVDIPPEDVSRKGRLNPGMMLLVDFEKHIVVDDEALKQQYSMARPYGEWLRRQKIELKDIVDSVPESKRKAPAVAGVVAASADDDSMENMGIHGLLAPLKAFGYTVEALEMLLLPMAKDGTEALGSMGNDTPLAVMSDREKLTFEYFKQMFAQVTNPPIDPIREKIVTSMECMIGPEGDLTETTEQQCHRLSLKGPLLSIEEMEAVKKMNYISWQSKIIDITYSKRRGRKGLEETLDRICAEASKAIKEGYTTLVLSDRAFSPERIAVSSLLAVGAVHHHLVRKLERTQVGLIIESAEPREVHHFCTLVGFGADAICPYLAIEAIWRLQVDGKIPSKANGEFFSKHELVKKYFKASNYGMMKVLAKMGISTLASYKGAQIFEALGLSSEVIEKCFAGTPSRVEGATFEMLAQDALDLHESAFPNRVFPPGSAEAVALPNPGSYHWRKGGEIHLNDPLAMAKLQEAARTNSVAAYKEYSRRIQELNKSCNLRGLLTFKEVAVKVPLDEVEPASEIVKRFCTGAMSYGSISLEAHTALAMAMNRIGGKSNTGEGGEQPSRMEPLPDGSVNPKRSAIKQIASGRFGVSSYYLTNADELQIKMAQGAKPGEGGELPGHKVIGDIAVTRNSTAGVGLISPPPHHDIYSIEDLAQLIHDLKNSNPAARISVKLVSEAGVGVIASGVVKGHADHVLISGHDGGTGAARWTGIKNAGLPWELGLAETHQTLVANDLRGRTVLQTDGQLKTGRDVAMAALLGAEEFGFSTAPLITLGCIMMRKCHKNTCPVGIATQDPVLREKFAGEPEHVINFFFMLAEEVREIMSQLGFRTMKEMVGRSDMLEVDREVTKTNEKLENIDLSLLLRPAAEIRPDAAQYCVQKQDHGLDMALDQKLISQSKAALEKSLPIYIEMPICNVNRAVGTMLSHEVTKRYHLAGLPTDTIHIKLSGSAGQSLGAFLCPGITLELEGDSNDYVGKGLSGGKIVVYPPKGSEFDPKENIVIGNVALYGATSGEAYFNGMAAERFCVRNSGARAVVEGVGDHGCEYMTGGTVVVLGKTGRNFAAGMSGGIAYVLDVDGKFQSCCNLELVDLDKVEEEEDIMTLRMMIQQHQRHTNSQLAKEVLVDFESLLPKFIKVFPRDYKRILADMKAGEATKNAQKNMEEEQEQDEGELMEKNAFEELKKMAAASTNAKASATVESVEAPKRPTQVHDAIKHGGFIAYEREGVKYRDPNVRMNDWKEVMEESKPGPLLKTQSARCMDCGTPFCHQENSGCPLGNKIPEFNELVYQNRWQEALDRLLETNNFPEFTGRVCPAPCEGSCVLGIIENPVSIKNIECSIIDKAFEEGWMVPRPPQKRTGKKVAIVGSGPAGLAAADQLNRMGHFVTVYERADRIGGLMMYGVPNMKTDKVDVVQRRVNLMAQEGVNFVVNASVGKDSSYSLDRLQKENDAIVLAVGATKPRDLPVPGRELSGVHFAMEFLHANTKSLLDSNLKDGNYISAKGKKVVVIGGGDTGTDCIGTSIRHGCSRIVNLELLSKPPEKRAPGNPWPQWPRVYRVDYGHQEAAAKFGKDPRSYEVLTKRFIGDENGVVKGLEVVRVGWEKDASGKFQLKEIEGSEEIIEADLVLLAMGFLGPESTIADKLGLERDGRSNFKADYGRFATNVEGVFAAGDCRRGQSLVVWAISEGRQAAAQVDRFLLPKEEDLTVDPENQEDLTSQQQDINKRQEGSGKFTVVT

SEQ ID NO: 14778 - protein, 2223 aa, Citrullus lanatus
MLAKPGSLLKLSAAPSTFDNTSVKPQLNVNPKARLGARAARCSALKGPTRLSNVSEKKFFGARLRAPGSGRVQFWHLDGPGRSPKLRLVVRSGLSAVPEKPLGLYDPSFDKDSCGVGFVAELSGETSRKTITDALEMLVRMSHRGACGCETNTGDGAGILLALPHEFFKEARIFAARDNGFELPPAGQYAVGMFFLPTSDSRREESKKVFAKVAESLGHSVLGWRSVQTDNTGLGKSALQTEPVIEQVFLTPSTRSKVDLEKQMYILRRLSMVAIRAALNLEHGGARDFYICSLSSRTIVYKGQLKPVQLKDYYLDLGNERFTSYMALVHSRFSTNTFPSWDRAQPMRVLGHNGEINTLRGNVNWMKAREGLLKCKELGLSEDELKHLLPIVDASSSDSGAFDGVLELLIRAGRSLPEAVMMMIPEAWQNDKNMDPQRKALYEYFSCLMEPWDGPALISFTDGRYLGATLDRNGLRPGRFYVTHSGRVIMASEVGVVDIAPEDVSRKGRLNPGMMLLVDFENHAVVDDEALKQQYSLARPYGEWLKKQKIELKDIVGSIDKRETTSPAIAGAMSAVDGNMKNMGIHGLLAPLKAFGYTTEALEMLLLPMAKDGVEALGSMGNDTPLAVMSNREKLTFEYFKQMFAQVTNPPIDPIREKIVTSMQCMIGPEGDLTETTEEQCHRLSLKGPLLSIEEMQAIKRMNYRGWQSKVLDITYPKYLGRRGLEETLDRICAEAHSAIKEGYTTLVLSDRAFSTKRVAVSSLLAVGAVHQHLVKNLERTQVGLIVESAEPREVHHFCTLVGFGADAICPYLAIEAIWRLQVDGKIPAKSSGEFHTKEELVKKYFKASNYGMMKVLAKMGISTLASYKGAQIFEALGLSSEVVEKCFAGTPSRVEGATFEMLARDAHNLHDMAFPSRAFPPGSAEAVALPNPGDYHWRKGGEIHLNDPVAIAKLQEAARTNSVNAYKEYSKLVHELNKACNLRGLLKFKETGASIPLDEVEPASEIVKRFCTGAMSYGSISLEAHTTLAMAMNKIGGKSNTGEGGEQPSRMEPLPDGSMNPKRSAIKQVASGRFGVSSYYLTNADELQIKMAQGAKPGEGGELPGHKVVGEIAKTRNSTAGVGLISPPPHHDIYSIEDLAQLIHDLKNSNPAARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITMGCIMMRKCHKNTCPVGIATQDPVLREKFAGEPEHVINFFFMVAEEMREIMSQLGFRTVNQMVGRSDVLEVDKEVAWQNEKLENIDLSLLLRPAADLRPEAAQYCVQKQDHGLDMALDQKLIALSKSALEKSIPVYIETPIINVNRAVGTMLSHEVTKRYHMAGLPSETIHIKFTGSAGQSLGAFLCPGIMLELEGDSNDYVGKGLSGGKIVIYPPKGSLFDPKENIIIGNVALYGATSGEAYFNGMAAERFCVRNSGAKAVVEGVGDHGCEYMTGGTVVILGKTGRNFAAGMSGGVAYVLDMDGEFESRCNLELVDLDKVEEEDDILTLKMMIQQHQRHTSSNLAKEVLDNFDNLLPRFIKVFPREYKRVLANKKAQEAAKEASEPSAKDAEESDEAELVEKDAFEELKKMAAASLNGNSKQVEKTEAPKRPTEIPDAVKHRGFIAYEREGVKYRDPNVRMGDWKEVMEESKPGPLLKTQSARCMDCGTPFCHQENSGCPLGNKIPEFNELVYQNRWREALERLLETNNFPEFTGRVCPAPCEGSCVLGIIENPVSIKNIECAIIDKAFEEGWMTPRPPPVRSGKRVAIVGSGPAGLAAADQLNKMGHRVTVYERADRIGGLMMYGVPNMKTDKVDVVQRRVKLMAEEGVNFVVNANVGTDPSYSLDQLRAENDALVLAVGATKPRDLPVPGRELAGVHFAMEFLHSNTKSLLDSNLQDGKYISAKDKNVVVIGGGDTGTDCIGTSIRHGCSSIVNLELLPQPPQTRAPGNPWPQWPRIFRVDYGHQEAAAKFGKDPRTYEVLTKRFIGDENGVVKGLEVIRVQWEKDANGRFQFKEVEGSEEILEADLVLLAMGFLGPESTIAEKLGVEKDDRSNFKAEYGRFSTSVDGIFAAGDCRRGQSLVVWAISEGRQAAAQVDKYLSKEDKNLPVGEGGYEGVGESSQDYNNRQQDSSSSSRHTVMT

SEQ ID NO: 14779 - protein, 2199 aa, Brassica rapa
MSAASSSSSLLQIRNNRLFPARSLRRDSTSVSQLAVASGVSRRGSCSVKNPFMGTRIKRSGSETLQLWRSDGPGRSPKLRTVVKSSFSGVPEKPMGLYDPSFDKDSCGVGFVAELSGETSRKTVTDSLEMLIRMTHRGACGCESNTGDGAGILVGMPHEFYAQAAKDLGFVLPPAGKYAVGMFFLPTAESRRDESKSVFTKVAESLGHSVIGWRSVPTDNSGLGKSALQTEPIIEQVFLTPTTKSQVDLEQQMYILRRLSMVAIRAALNLEHGAMKDFYICSLSSRTVVYKGQLKPDQLKEYYYADLGSERFTSYMALVHSRFSTNTFPSWDRAQPMRVLGHNGEINTLRGNVNWMRAREGLLKCKELGLSKQELKKLLPIVDVSSSDSGAFDGVLELLVRAGRSLPEAVMMMIPEAWQNDKNIDPSRKSFYEYLSALMEPWDGPALISFTDGRYLGATLDRNGLRPGRFYITHSGRVIMASEVGVVDVPPEDVMRKGRLNPGMMLLVDFEKHIVVDDDALKQQYSQARPYGEWLERQKIELKDIIKSVPETERIAPPISGAVTASSDDDSMESMGIHGLLSPLKAFGYTVEALEMLLLPMAKDGTEALGSMGNDAPLAVMSNREKLCFEYFKQMFAQVTNPPIDPIREKIVTSMECMIGPEGDLTETTEEQCHRLSLKGPLLTIEEMESVKKMNYRGWRTKVLDITYPKEEGTKGLEMTLDRICAEANEAIKEGYTLLVLSDRAFSSTRVAVSSLLAVGAVHHHLVKSLARTQVGLIVESAEPREVHHFCTLVGFGADAICPYLAVETVHRLQVDGKIPPKSNGEFHSKEELVKKYYKASNYGMMKVLAKMGISTLASYKGAQIFEALGLSSEVIEKCFAGTPSRVEGATFEMLARDALLLHEMAFPARAYAPGSAEASALSNPGNYHWRKNGEIHLNDPLAIAKLQEAARTNSVAAYKEYSKRINELNKQSNLRGLMKFKEADVKIPLDEVEPASEIVKRFCTGAMSYGSISLEAHQTLAMAMNKLGGKSNTGEGGELPSRMEPLPDGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTLTEMIGRADMLELDREVVKNNDKLANIDLSLLLRPAAEIRPGAAQYCVQKQDHGLDMALDQELIALSKSALEKSLPVYIETPICNVNRAVGTMLSHEVTKRYHLAGLPKDTIHIKFSGSAGQSLGAFLCPGITLELEGDSNDYVGKGLSGGKVVVYPPKGSSFDPKENIVIGNVALYGATSGEAYFNGMAAERFSVRNSGAQAVVEGVGDHGCEYMTGGTVVVLGKTGRNFAAGMSGGIAYVLDVDGKFHTRCNLELVDLDKVEDDEDKMTLKMMIQQHQRHTNSQLAQEVLGDFENLLPKFIKVFPRDYKRVLAAMKDEEVSKQAIDRAAEEAEEMEEKEVEEKDAFAELKNMAAAASSKEVVSGNGAATEAPKKPSLVDNAVKHRGFIAYEREGVKYRDPNVRMNDWNEVMEESKPGPLLKTQSARCMDCGTPFCHQENSGCPLGNKIPEFNELVYQNRWQEALNRLLETNNFPEFTGRVCPAPCEGSCVLGIIENPVSIKSIECSIIDKAFEEGWMVPRPPLTRTGKKVAIIGSGPAGLAAADQLNKMGHSVTVYERADRIGGLMMYGVPNMKTDKIDIVQRRVDLMTKEGINFVVNANIGKDPSYSLDGLKEENDAIVLAVGSTKPRDLPVPGRDLTGVHFAMEFLHANTKSLLDSNLEDGNYISAKGKKVVVIGGGDTGTDCIGTSIRHGCTNIVNLELLPQPPSTRAPGNPWPQWPRVFRIDYGHQEAATKFGKDPRTYEVLTKRFIGDDNGNVKGLEIVRVSWEKDESGRFNFKEIEGSEEIIEADLVFLAMGFLGPEPTLAEKLGLECDNRSNFKAEYGRFSTTVGGVFAAGDCRRGQSLVVWAISEGRQAASQVDKFLSKNEDDLVDATVGQNLNEVKHQH

SEQ ID NO: 14780 - protein, 2226 aa, Fragaria vesca
MLAASSGSVLQLRTKPSVLASPQLNASPIARLSTGRAATSRSASKAIANKFFGTRLRAAAGSERLHLWRSEGPGRSPKLKVVVRSMLSAVPEKPQGLYDPKMDKDSCGVGFVAELSGESSRKTITDALEMLVRMTHRGACGCETNTGDGAGVLVAIPHDFYKEAAKDIGFELPALGEYAVGMLYLPTSESRREESKNVFTKVAESLGHTVLGWRSVPTDNSDLGNSALQTEPVIEQVFLTPTPRSKVDLERQMYILRRVSMVAIRAALNLQYGGAKDFYICSLSSRTVVYKGQLKPEQLKGYYYADLGNERFTSYMALVHSRFSTNTFPSWDRAQPMRVIGHNGEINTLRGNVNWMKAREGLLKCTELGLSKNELKKLLPIVDASSSDSGAFDGVLELLVRAGRSLPEAIMMMIPEAWQNDKNMDPDKRALYEYFSSLMEPWDGPALISFTDGRYLGATLDRNGLRPGRFYVTHSGRVIMASEVGVVDVPPEDVCRKGRLNPGMMLLVDFENHIVVDDEALKKQYSLARPYGEWLKRQKIELKDIVDSVNESDRVPPSIAGVAPASTDDEDMENMGVHGLLAPLKAFGYTVEALEMLLLPMAKDGVEALGSMGNDTPLAVMSNREKLTFEYFKQMFAQVTNPPIDPIREKVVTSMECMIGPEGDLTETTEEQCHRLSLKGPLLNIEEMEAIKKMNYRGWRCKVLDITYSKERGRKGLEETLDRICAEAREAIKKGYTTLVLSDRAFSPKRVAVSSLLAVGAVHQHLVKNLERTRVGLIIESAEPREVHHFCTLVGFGADAICPYLAVEAIWRLQVDGKIPPKSNGTIYSKAELVKKYFKASNYGMQKVLAKMGISTLASYKGAQIFEALGLSSEVIERCFVGTPSRVEGATFEMLARDGLHLHDLAFPSRAFPPGSAEAVALPNPGDYHWRKGGEVHLNDPFAISKLQEAARTNSVAAYKEYSKLIHQLNKACNLRGLLKFKNTEQQIHLDEVEPASEIVKRFCTGAMSYGSISLEAHTTLAIAMNRMGGKSNTGEGGEQPSRMEPLPDGSMNPKRSSIKQVASGRFGVSSYYLTNADELQIKMAQGAKPGEGGELPGHKVIGDIAVTRNSTAGVGLISPPPHHDIYSIEDLAQLIHDLKNANPGARISVKLVSEAGVGVVASGVVKGHADHVLIAGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMVAEEVREIMAQLGFRTLNEMVGRSDMLEVDKEVTKDNEKLNNIDLSLLLRPAADIRPEAAQYCVQKQDHGLDMALDHKLISLSNSAIEKAVPVYFETPVCNVNRAVGTMLSHEVTKRYNRQGLPADTIHIKFNGSAGQSLGAFLCPGITLELEGDSNDYVGKGLSGGKIIVYPPKESKFDPKENIVIGNVALYGATSGEAYFNGMAAERFCVRNSGARAVVEGVGDHGCEYMTGGTVVVLGKTGRNFAAGMSGGIAYVFDVDGKFLSRCNPELVDLDKVEEEEDILTLRMMIQQHQRHTKSLLASEVLADFENLLPKFIKVIPREYKRALANLREEASKQAVEDADEEAEKQEEEELKLKEKDAFEELKKMASASLNELKNMASASLNGNSNQVKVQVEDAETLKRPKEVSKAVKHRGFISYEREGVQYRDPNVRMNDWDEVMEETKPGPLVNTQSARCMDCGTPFCHQENTGCPLGNKIPEFNELVYQNRWHDALERLLETNNFPEFTGRVCPAPCEGSCVLGIIENPVSIKSIECAIIDKAFEEGWMVPRPPVKRTGKKVAIVGSGPAGLAAADQLNRIGHTVTVYERADRIGGLMMYGVPNMKADKVDVVQRRVNLMAEEGVNFVVNANVGNDSSYSFDRLREENNAIILAVGATKPRDLPVPGRELSGVHFAMEFLHANTKSLLDSNLENGNYISAKGKKVVVIGGGDTGTDCIGTSVRHGCTDIVNLELLPQPPQTRAPGNPWPQWPRIFRVDYGHAEVAAKFGKDPRTYEVLTKRFVGDENGVVKGIEVVRVKWEKDATGKFQFKEIEGSEEIIEADLVLLAMGFLGPEAAIAEKLGLECDNRSNFKADYGRFSTNVDGVFAAGDCRRGQSLVVWAISEGRQAAAQVDNYLCKEEEDHTDSNSSPESDLLKRHQEITKSQKTVASTS

SEQ ID NO: 14781 - protein, 2215 aa, Papaver somniferum
MSALSGSVFQARNSSIVLPSSTRCSVNNDQWNVVVPLRRNGSSSSTTRCSSNTRRENLFTENKFLGTRLRSSPERFQLWRSDGPGRSPTLRVVVRSMLSQVPEKPLGLYDPSFDKDSCGVGFVAELSGISSRKTVTDAIEMLVRMTHRGACGCEQNTGDGAGILVALPDDFFIEVAKDVGFQLPPAGEYAVGMLFMPTSDSRREESKIVFTKVAESLGHEVLGWRTVPTDNSGLGKSALQTEPVVEQVFLAKSPRSKADFEQQMYILRRVAMVAIRAALNLQHGGVKDFYICSLSSRTIVYKGQLKPDQLKNYYYADLNNQKFTSYMALVHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPERKALYEYFSALMEPWDGPALISFTDGRYLGATLDRNGLRPGRFYVTHSRRVVMASEVGVVDIPPEDVCRKGRLNPGMMLLVDFEKHIVVDDAALKKQYSAARPYREWISKQKITLKDIVSSLNASDMVPPLISGVVPVSKMDESMENMGVRGLLAPLKAFGYTVEGLEMLMLPMAKDGTEALGSMGNDAPLAVMSNREKLAFEYFKQMFAQVTNPPIDPIREKIVTSMECMIGPEGDLTETTEEQCHRLSLKGPLLSIQEMEAIKKMNYRGWRSKVVDITYSKIRGKKGLEETLDRICGEAHTAIKEGYTTLVLSDRAFSSKRVAVSSLLAVGAVHQHLVSKLERTRIGLIVESAEPREVHHFCTLVGFGADAICPYLAIEAIWRLQIDGKIPSRSSGELHTKEELVKKFFKASNYGMMKVLAKMGISTLASYKGAQIFEALGLSSEVIQKCFNGTPSRVEGATFEMLARDALRLHELAFPARVLPAGSAEAVALPNPGDYHWRKNGEVHLNDPLAISKLQEAARTNSVAAYKEYSKRIQELNKSCNLRGMLKFRDSEVKVPLEEVEPASEIVKRFCTGAMSYGSISLEAHTSLAVAMNTIGGKSNTGEGGENPSRMEPLPNGSMNPKRSAIKQVASGRFGVSSYYLTNADEIQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTTLQTDGQLKTGRDVAIAALLGAEEFGFSTAPLITLGCIMMRKCHKNTCPVGIATQDPVLREKFAGEPEHVINFFFMLAEEMREIMSDLGFRTINEMIGRSDMLEVDKEVVKCNEKLENIDLSLLLRPARDIRPEAAQFCIQKQDHGLDMALDRKLITLSEPALEKKFPVYIDVPIKNVNRAVGTMLSHEVTKRHHLEGLPKDTIHIKLSGSAGQSLGAFLCPGIMLELEGDSNDYVGKGLSGGKIVVYPPRNSRFDPKENIVIGNVALYGATCGEAYFNGMAAERFCVRNSGAKAVVEGVGDHGCEYMTGGTVVVLGKTGRNFAAGMSGGIAYVLDRDQTFSTRCNLELVDLDKVEEEEDKSTLMMMIQQHQRHTKSELAKEVLADFDNLLSKFVKVFPRDYKRVLQDMKAQTGKKEADPQAPSDTEDPDEAEWKEKDAFEELKKLAAAGRKASEVKEAGEEEEESPARPTSVTGAVKHRGFIAYERESISYRDPTVRMSDWDEVMIESKPGPLLKTQSARCMDCGTPFCHQENSGCPLGNKIPEFNELVFQNRWREALDRLLETNNFPEFTGRVCPAPCEGSCVLGIIDNPVSIKNIECSIIDKGFEEGWIVPRPPVVRTGKRVAVVGSGPAGLAAADQLNKMGHLVTVFERADRIGGLMMYGVPNMKADKMGVVQRRVNLMAAEGINFVVNASVGNNPMYSLEKLRNEHDAIVLALGATKPRDLPVPGRELSGVHFAMEFLHANTKSLLDSNLEDGRYISAEGKKVVVIGGGDTGTDCIGTSIRHGCTSVVNLELLPEPPRTRAPGNPWPQWPRIFRVDYGHQEAATKFGKDPRSYEVLTKRFVGDENGVIKGLELVRVQWDKDASGKFQFKEVEGSEEVIEADLVLLAMGFLGPESTVADGLGLEKDNQSNYKAEYGRFSTNVEGVFAAGDCRRGQSLVVWAISEGRQAAAQVDKYLMEGEDEADHNSISDDNLKNQLERAYKP

SEQ ID NO: 14782 - protein, 2195 aa, Phaseolus vulgaris
MSNALSFTLPALNNPQISAFNSPNKARLHLRSRVARCPASTVEKKRLFGAQVRSSGFDRIRLLQSGRLPKWRVAVRSAFSAVPEKPLGLYDPAMDKDSCGVGFVAELSGECNRRTVTDALEMLVRMTHRGACGCEANTGDGAGILVALPHVFYQEVVDFELPPQGKYAVGMFFLPKSENRRKESKKLFSKVAESLGHTVLGWRSVPTDNTGLGKSALQTEPVIEQVFLTPSAESKVDLERQMYILRKLSMAAITSALNLQNDGITDFYICSLSSRTVVYKGQLTPAQLRDYYFADLGNERFTSYMALIHSRFSTNTFPSWDRAQPMRVLGHNGEINTLRGNVNWMKAREGLLKCKELGLSENKLKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDICRKGRLNPGMMLLVDFEKHAVVNDDALKEQYSLARPYEDWLKNQKIELKDIVDSVPKSGRVPPPIAGVAPPSNDDEDMVNMGIHGLLAPLKAFGYSVESLEMLLLPMAKDGVEALGSMGNDTPLAVMSNREKLTFEYFKQMFAQVTNPPIDPIREKIVTSMQCMVGPEGDLTEITEEQCHRLSLKGPLLYTEEMEAIKKMNYRGWHSKVIDITYSKERGKGGLEEALDRICAEAHDAISEGYTTLVLSDRAFSRKRVAVSSLLAVGAVHQHLVKTLERTRVALIVESAEPREVHHFCTLVGFGADAICPYLAIETIWRLQVDGKIPPKSSGEFHSKEELVKKYFKASNYGMMKVLAKMGISTLASYKGAQIFEALGLSSKVIEKCFAGTPSRVEGATFETLARDAFQLHELAFPSRVFSPGSAEAVTLPNPGDYHWRKGGEVHLNDPLAIAKLQEAARTNSVDSYKQYAKFIHELNKACNLRGLLKFKETAVKIPIDEVEPASEIVKRFCTGAMSYGSISLEAHTALAMAMNKIGGKSNTGEGGEQPSRMEPLPNGTMNPKRSAIKQVASGRFGVSSYYLTNADELQIKMAQGAKPGEGGELPGHKVIGDIAVTRNSTAGVGLISPPPHHDIYSIEDLAQLIHDLKNANPTARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGRSDMLEVDKEVIKSNEKLENIDLSLLLRPAAELRPEAAQYCVQKQDHGLENALDNKLISLSNAALEKGLPVYIETPIYNVNRAVGTMLSHEVTKRYHLAGLPSDTIHIRFTGSAGQSFGAFLCPGITLELEGDSNDYVGKGLSGGKIVVYPPKGSNFDPKENIVIGNVALYGATQGEAYFNGMAAERFCVRNSGAKAVVEGVGDHGCEYMTGGTVVVLGETGRNFAAGMSGGIAYVLDLDGKFQSRCNLELVDLDKVEEEEDVYTLRMLIQQHQRHTNSLLANEVLDDFENLLPKFIKVFPREYKRVLASVKSEEASKDAVVQAAKDAEDQDDEAQAVEKDAFEELKKLATVSLNEKQSQAETPKRPSQVTDAIKHRGFVAYEREGVQYRDPNVRMADWNEVMEETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPSGLAAADQLNKMGHAVTVYERADRIGGLMMYGVPNMKSDKVDVVQRRVNLMAEEGVDFVVNANVGNDPLYSLDRLREENDAIVLAVGSTKPRDLPVPGRELSGVHFAMEFLHANTKSLLDSNLEDGSYISAKGKKVVVIGGGDTGTDCIGTSIRHGCSSIVNLELLPQPPPTRAPGNPWPQWPRIFRVDYGHQEAAAKFGKDPRSYEVLTKRFLGDENGVLKGLEVIRVCWEKDETGRFQFKEIEGSEEIIEADLVLLAMGFLGPEPTIAEKLGLDRDNRSNFKADYGRFSTNVKGVFAAGDCRRGQSLVVWAISEGRQAAAQVDNYLVKDDDEHRNQDGLVKRQQGLNKKQQGSSKHTVMT

SEQ ID NO: 14783 - protein, 2187 aa, Malus domestica
MLASTGGSVVQLRTKPSLLPSCSPSRKSCKALAKKFFGTRLRASGSERLHLWRSDGPGRSPKLRVVVRNMLSAVPEKPLGLYDPSFDKDSCGVGFVAELSGEGSRKTITDAIEMLVRMTHRGACGCETNTGDGAGILVGVPHDFYKEVTKDAGFDIPPAGEYAVGMFFLPTSESRREESKRVFAKVAESLGHTVLGWRSVPTDNSDLGNSALQTEPVIEQVFLTATPKSKVDFERQMYILRRLSMVAIRAALNLEHGGAKDFYICSLSSRTVVYKGQLKPVQLKGYYYADLGNERFTSYMALVHSRFSTNTFPSWDRAQPMRVIGHNGEINTLRGNVNWMKAREGLLKCKELGLSENDLKKLLPIVDASSSDSGAFDAVLELLVQAGRSLPEAIMMMIPEAWQNDKNMDPDRKALYEYFSSLMEPWDGPALISFTDGRYLGATLDRNGLRPGRFYVTHSGRVIMASEVGVVDIPPEDVSRKGRLNPGMMLLVDFENHVVVDDEALKQQYSLARPYAEWLQRQKIELKDIVDSVHESDRVPPSIAGVIPASTNDETMENMGIHGLLAPLKAFGYTVESLEMLLLPMAKDGVEALGSMGNDTPLAVMSKREKLTFEYFKQMFAQVTNPPIDPIREKVVTSMECMIGPEGALTETTEEQCHRLSLKGPLLTIDEMEAIKKMNYRGWRCKVLDITYSKGRGREGLEETLDRICSDAHEAIKKGYTTLVLSDRAFSPKRVAVSSLLAVGAVHQHLVKNLERTQVGLIIESAEPREVHHFCTLVGFGADAICPYLAIEAIWRLQVDGKIPPIANGAIYSKDELVKKYFKASTYGMMKVLAKMGISTLASYKGAQIFEALGLSSEVIERCFAGTPSRVEGATFEMLAHDELHMHELAFPSRSYPPGSAEAVALPNPGDYHWRKGGEVHLNDPVAIAKLQEAARTNSVAAYKEYSKLIHELNKACNLRGLLRFKNTEQQIHLDEVEPASEIVKRFCTGAMSYGSISLEAHSTLAIAMNRIGGKSNTGEGGEQPSRMEPLPDGSRNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGVVASGVVKGHADHVLISGHDGGTGASRWTGIKNAGLPWELGLAETHQTLVSNDLRGRTTLQTDGQLKTGRDVAIATLLGAEEFGFSTAPLITLGCIMMRKCHKNTCPVGIATQDPVLREKFAGEPEHVINFFFMIAEELREIMAQLGFRTINEMVGRSDMLEVDREVTKNNEKLDNIDLSLLLRPAADLRPGAAQYCVEKQDHGLDMALDHKLISMSKAALEKALPVYFETPICNVNRAVGTMLSHEVTKRYNRAGLPADTIHIKFSGSGGQSLGAFLCSGIMLELEGDSNDYVGKGLSGGKIVVYPPKGSRFDPKENIVIGNVALYGATSGEAYFNGMAAERFCVRNSGAKAVVEGVGDHGCEYMTGGTVVVLGKTGRNFAAGMSGGIAYVYDVDGQFRSRCNPELVDLDTLEEEDILTLQMMIQQHQRHTNSLLAVQVLADFENLLPKFIKVIPREYKRVLADMKEETKQVIEHKEEDEPELEEKDAFQELKKLAAASLNGKSNQKVEDAEALKRPSQVTDAVKHRGFIYYEREGVQYRDPNVRMNDWKEVMEETKPGPLVKTQSARCMDCGTPFCHQENSGCPLGNKIPEFNELVYQNRWHEALERLLETNNFPEFTGRVCPAPCEGSCVLGIIENPVSIKSIECAIIDKAFEEGWMVPRPPVKRTGKRVAIVGSGPAGLAAADQLNRIGHTVTVYERADRIGGLMMYGVPNMKTDKKEIVQRRVNLMAEEGVNFVVNANIGNDPLYSLDRLREENNAIVLAVGATKPRDLPVPGRELSGVHFAMEFLHANTKSLLDSNLEDGNYISAKGKKVVVIGGGDTGTDCIGTSVRHGCTNIINLELLPEPPRKRAPGNPWPQWPRVFRVDYGHQEVAAKFGKDPRTYEVLTKRFVGDENGALKGLEVVRVKWEKDETGRFQFNEIEGSEEILEADLVLLAMGFLGPEATVAEKLGLERDQRSNYKADYGRFSTNVDGVFAAGDCRRGQSLVVWAISEGRQVAAQVDKYLSKEEEDHAISNGSHQNVGKRHRDLNPTGTSKHTVMT

SEQ ID NO: 14784 - protein, 2027 aa, Cucumis sativus
MFFLPTSDSRREESKKVFAQVAESLGHSVLGWRSVQTDNTGLGKSALLTEPVIEQVFLTPSTKSKVDLEKQMYILRRLSMVAIRAALNLEHGGARDFYICSLSSRTIVYKGQLKPVQLKDYYLDLGNERFTSYMALVHSRFSTNTFPSWDRAQPMRVLGHNGEINTLRGNVNWMKAREGLLKCKELGLSEDELKHLLPIVDASSSDSGAFDGVLELLIRAGRSLPEAVMMMIPEAWQNDKNMDPQRKALYEYFSCLMEPWDGPALISFTDGRYLGATLDRNGLRPGRFYVTHSGRVIMASEVGVVDIAPEDVSRKGRLNPGMMLLVDFENHVVVDDEALKQQYSLARPYGEWLKNQKIELKDVISSIDKSEMTSPTIAGALSAEDNMNNMGIHGLITPLKAFGYTTEALEMLLLPMAKDGVEALGSMGNDTPLAVMSNREKLTFEYFKQMFAQVTNPPIDPIREKIVTSMQCMIGPEGDLTETTEEQCHRLSLKGPLLSIGEMEAIKKMNYRGWRSKVLDITYPKYLGRRGLEETLDRICSEAQNAINEGFTTLVLSDRAFSSKRVSVSSLLAVGAVHQYLVKNLERTQVGLIVESAEPREVHHFCTLVGFGADAICPYLAIEAIWRLQIDGKIPAKSSGEFHTKEELVKKYFKASNYGMMKVLAKMGISTLASYKGAQIFEALGLSSEVVEKCFAGTPSRVEGATFEMLARDAHNLHEMAFPSRAFPPGSAEAVALPNPGDYHWRKGGEIHLNDPVVMAKLQEAARTNSVNAYKEYSKLVHELNKACNLRGLLKFKETGASIPLDEVEPASEIVKRFCTGAMSYGSISLEAHTTLAMAMNKIGGKSNTGEGGEQPSRMEPLPDGSMNPKRSSIKQVASGRFGVSIYYLTNADELQIKMAQGAKPGEGGELPGHKVVGEIAKTRNSTAGVGLISPPPHHDIYSIEDLAQLIHDLKNSNPAARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITMGCIMMRKCHKNTCPVGIATQDPVLREKFAGEPEHVINFFFMVAEEMREIMSQLGFRTVNQMVGRSDVLEVDKEVAWQNEKLENIDLSLLLRPAADLRPEAAQYCVQKQDHGLDMALDQKLIALSKSALEKSIPVYIETPIINVNRAVGTMLSHEVTKRYHMAGLPSETIHIKFSGSAGQSLGAFLCPGIMLELEGDSNDYVGKGLSGGKIVVYPPKGSLFDPKENIIIGNVALYGATSGEAYFNGMAAERFCVRNSGAKAVVEGVGDHGCEYMTGGTVVILGKTGRNFAAGMSGGIAYVLDMDGKFESRCNLELVDLDKVEEEDDILTLKMMIQQHQRHTSSNLAKEVLDNFENLLPRFIKVFPREYKRILANIKVQEAVKEASEPSAKDAEELDEAELVEKDAFEELKKMAAASLNGNSEQTEPPKRPTEIPDAVKHRGFIAYEREGVKYRDPNVRMGDWNEVMEESKPGPLLKTQSARCMDCGTPFCHQENSGCPLGNKIPEFNELVYQNRWREALERLLETNNFPEFTGRVCPAPCEGSCVLGIIENPVSIKNIECAIIDKAFEEGWMIPRPPQARSGKQVAIVGSGPAGLAAADQLNKMGHKVTVYERADRIGGLMMYGVPNMKTDKVDVVQRRVNLMAEEGVNFVVNANVGTDPSYSLDQLRKENDALVLAVGATKPRDLPVPGRELAGVHFAMEFLHSNTKSLLDSNLQDGNYISAKDKKVVVIGGGDTGTDCIGTSIRHGCSRIVNLELLPQPPQTRAPGNPWPQWPRIFRVDYGHQEAAAKFGKDPRTYEVLTKRFIGDENGVVKGLEVIRVQWEKDADGRFQFKEVEGSEEIIEADLVLLAMGFLGPESTVAEKLSIEKDNRSNFKAEYGRFSTTVDGVFAAGDCRRGQSLVVWAISEGRQAAAQVDKYLAKEDKGGIVGEGGYEGVGNGSQDYKNRQQDSSSSSRHTVMT

SEQ ID NO: 14785 - protein, 2211 aa, Aquilegia formosa
MSVISGSAFQLKSNSVVLNSINRSIITNHHGLSVVSPLNYRTKNRICSVKKSDNDNVIEHKFYGTRLRQQSSSERFHLWRTEGPGRSPKLRVAVRSMALSQVPEKPLGLYDPSFDKDACGVGFVAELSGESHRKTVMDAIEMLVRMTHRGACGCETNTGDGAGILVGLPHEFFMEVAKDMGFQLPPRGNYAVGMLFLPTSENRRQESKAVFTKVAESLGHTVLGWRPVPTDNTGLGKSALETEPVVEQVFLTPSPRSKADFEQQMYILRRFSMEAIRSALNLQHGGVKDFYICSLSSRTIVYKGQLKPDQLKDYYYADLGDERFKSYMALVHSRFSTNTFPSWDRAQPMRIVGHNGEINTLRGNVNWMRAREGLLKCKELGLTKNEMKTLLPIVDHSSSDSGAFDGVLELLVRAGRSLPEAVMMMIPEAWQNDKNMDPERKAFYEYFSTLMEPWDGPALVSFTDGRYLGATLDRNGLRPGRFYITHSGRVIMASEVGVVDVPPEDVCRKGRLNPGMMLLVDFENHVVVDDDALKKQYSFAKPYGEWLKRQKIELKDIVESVHKSDRAPPVISGALSAAVNGDTVDNKGIHGLLAPLRAFGYTVEALDMLLLPMAKDGTEALGSMGNDAPLAVMSDREKLTFEYFKQMFAQVTNPPIDPIREKIVTSMECMIGPEGDLTETTEEQCHRLSLKGPLLTIEEMEAIKKMNYRGWRSKVLDITYSKTRGRKGLEETLDRICYEACNAIKDGFTTLVLSDRAFSSKRVAVSSLLAVGAVHHHLVSKLERTRVGLIIESAEPREVHHFCTLVGFGADAICPYLAIETVWRLQIDGRIPPKSSGDFHSKEELVRKYFKASNYGMMKVLAKMGISTLASYKGAQIFEALGLSSEVIRKCFSGTPSRVEGATFEMLAQDALQLHELGFPSRFLPPGSAEEVALPNPGDYHWRKGGEVHLNDPLAIAKLQEAARTNSVAAYKEYSKRIQELNKSCNLRGMLKFKDAEVQVPLGEVEPASEIVKHFCTGAMSYGSISLEAHTTLALAMNKIGGKSNTGEGGENPSRMKPLPDGSMNPKRSSIKQVASGRFGVSINYLTNADELQIKMAQGAKPGEGGELPGHKVIGDIAVTRNSTAGVGLISPPPHHDIYSIEDLAQLIHDLKNSNPKARISVKLVSEAGVGVIASGVVKGHADHVLISGHDGGTGASRWTGIKSAGLPWELGLAETHQTLVANDLRGRTTLQTDGQLKTGRDVAIAALLGAEEFGFSTAPLITLGCIMMRKCHKNTCPVGIATQDPVLREKFAGEPEHVINFFFMLAEEVREIMSQLGFRTMKEMVGRSDMLEVDSEVVKNNEKLENIDLSLLLKPAAEIRPEAAQYCIQKQDHALDMALDQKLITLSNAALQRSLPVYIELPICNVNRAVGTMLSHEVTKRYHVDGLPADTIHIKLTGSAGQSLGAFLCPGIMLELEGDSNDYVGKGLSGGKIVVYPPRKSTFNPKENIVIGNVALYGATSGEAYFKGMAAERFCVRNSGAKAVVEGIGDHGCEYMTGGIVVILGKTGRNFAAGMSGGIAYVFDVDKTFQSRCNLELVDLDKVEDDEDIMTLRMMIQQHQRYTKSELAWEILDDFQNLLPKFIKVFPRDYKRVLQNMKVEKAVPQVDMQAENQEEAELMEKDAFEELKKLAVKSQHEKGSQVDEAQSLKRPTEVHDAVKHRGFVAYDRETISYRNPENRINDWKEVMEKSKPGPLLKTQSARCMDCGTPFCHQDNYGCPLGNKIPEFNELVYQNRWREALDRLLETNNFPEFTGRVCPAPCEGSCVLGIIENPVSIKSIECSIIDKAFDEGWMIPRPPLRRTGKKVAIVGSGPAGLAAADQLNRMGHSVTVFERADRIGGLMMYGVPNMKADKVNIVQRRVNLMAEEGINFVVNANVGSDPIYSIERLRSENDAIILSLGATKPRDLPVPGRELSGIHFAMEFLHANTKSLLDSNLQDGKYISAKGKKVVVIGGGDTGTDCIGTSLRHGCTNIVNLELLPEPPQKRAPGNPWPQWPRIFRVDYGHQEALTKFGKDPRSYEVLTKRFVGDKNGFVKGVEVVQVHWEKDSSGRFQFKEIEGSEMIIEADLVFLAMGFLGPEPIIADQLGLEQDNRSNYKAEYGRFLTSVEGVFAAGDCRRGQSLVVWAISEGRQAASQVDEYLMREMEDLSNTTNQETVNRQHNNSKYSVMR

SEQ ID NO: 14786 - protein, 2200 aa, Arachis hypogaea
MSSSSLSFAAAPAWSACTLPSNIASSRTQLNVRTVAKAKPMSFFGTRLRSSCRSLGSERLHVWRSQGPGRSPELRVVVRSALSAVPEKPMGLYDPAMDKDSCGVGFVAELSGEGNRKTVTDALEMLVRMTHRGACGCEANTGDGAGILVALPHQFYTEVVDFELPPPGKYAVGMFFLPTSDSRREESKNVFRKVAESLGHSVLGWRSVPTDNTGLGKSALQTEPVIEQVFLTPSTKSKLDLERQMYILRKLSDAAITSALDLHSDGIADFYTCSLSSRTVVYKGQLTPAQLKGYYFADLGNERFTSYMALIHSRFSTNTFPSWDRAQPMRVLGHNGEINTLRGNVNWMKAREGLLKCKELGLSENELKKLLPIVNTTSSDSGAFDGVLEFLVQSGKSLPEAVMMMIPEAWQNDKNMDPQRKAFYEYFSALMEPWDGPALISFTDGHYLGATLDRNGLRPGRFYVTHSGRVIMASEVGVVDIPPEDVCRKGRLNPGMMLLVDFEKHAVVNDDALKEQYSLSRPYGEWLKNQKIQLQDIVDSVHESERVPPSIAGVIPASGDDADMENMGIHGLLTPLKAFGYTVESLEMLLLPMAKDGTEALGSMGNDTPLAVMSNREKLTFEYFKQMFAQVTNPPIDPIREKIVTSMECMVGPEGDLTEITEEQCHRLSLKGPLLSIEQMEAIKKMNYRGWRSKVIDITYSKDCGKKGLDEALDRICAEAHDAINAGYTTLVLSDRAFSRKRVSVSSLLAVGAVHQHLVKTLERTRVALMVESAEPREVHHFCTLVGFGADAICPYLAIETIWRLQVDGKIPPKAGGEFYSKGELVKKYFKASNYGMMKVLSKMGISTLASYKGAQIFEALGLSSEVIERCFAGTPSRVEGATFEMLARDALKLHELAFPPRVFSPGSAEAVALPNPGDYHWRKGGEIHLNDPLAIAKLQEAARTNSVDAYKQYSKIIHELNKACNLRGILKFKEAAVKISLDEVEPASEIVKRFCTGAMSYGSISLEAHTTLATAMNKIGGKSNTGEGGEQPSRMEPLPDGSMNPKRSAIKQVASGRFGVSSYYLTNADELQIKMAQGAKPGEGGELPGHKVVGDIAVTRNSTPGVGLISPPPHHDIYSIEDLAQLIHDLKNANPAARISVKLVSEAGVGIIASGVVKGHADHVLISGHDGGTGASRWTGIKNAGLPWELGLAETHQTLVANDLRGRTTLQTDGQLKTGRDVAIAALLGAEEFGFSTAPLITLGCIMMRKCHKNTCPVGIATQDPVLREKFAGEPEHVINFFFMVAEEMREIMAQLGFRTVNEMVGRSDMLEVDKEVTKTSEKLQNIDLSLLLRPAAELRPEAAQYCVQKQDHGLDMALDNKLIGLSHAALEKGLPVYIESPIYNVNRAVGTMLSHEVTKRYLLDGLPNDTIHIRFTGSAGQSFGAFLCPGITLELEGDSNDYVGKGLSGGKIVVYPPKKSTFDPKTNIVIGNVALYGATRGEAYFNGMAAERFCVRNSGAKAVVEGVGDHGCEYMTGGIVVVLGNTGRNFAAGMSGGIAYVLDMDGKFQSRCNQELVDLDKVEEEEDIITLRMLIQQHQRHTDSVLAKEVLSDFENLLPKFIKVFPREYKRVLAGMKSKEASKNASSPAAIAEEGPDEAELNEKDAFEELKKMAAASSNGKPSQKVEQAESSKRPSRVTDAVKHRGFVAYEREGVQYRDPNVRMNDWKEVMEESKPGPLLKTQSARCMDCGTPFCHQENSGCPLGNKIPEFNELVYQNRWREALERLLETNNFPEFTGRVCPAPCEGSCVLGIIENPVSIKSIECAIIDKGFEEGWMVPRPPPKRTGRRVAIVGSGPAGLAAADQLNKMGHTVTVYERADRIGGLMMYGVPNMKTDKVDIVQRRVNLMAEEGVNFMVNANVGHDPMYALGRLQEENDAIVLAVGATKPRDLPVPGRELSGVHFAMEFLHANTKSLLDSNLQDGNYISAKGKKVVVIGGGDTGTDCIGTSIRHGCSSIVNLELLPQPPETRAPGNPWPQWPRVFRIDYGHQEAAAKFGKDPRSYEVLTKRFVGDENGVLKGLEVIRVRWEKDETGKFQFKEIEGSEEIIEADLVLLAMGFLGPESTIAEKLGMERDNRSNFKADYGRFSTSVKGVFAAGDCRRGQSLVVWAISEGRQAASQVDRYLTKEDTEYNIAHTKRQQQDLTKRQQGGSKYTVMT

SEQ ID NO: 14787 - protein, 2191 aa, Glycine max
MSCSLSFSRLSARSARTLPRENEKPRLNARCPVRVTKFLGTRLRSSGRSLRSERFHVWQSEGPGRTPKLRVAVRSALSAVPNKPLGLYDPAMDKDSCGVGFVAELSGESSRQTVTDALEMLVRMTHRGACGCEANTGDGAGIMVALPHQFYKEVVDFELPPPGKYAVGMLFLPTSNSRREESKNVFQKVAESLGHSVLGWRSVPTDNTGLGKSAVLTEPVIEQVFLTPSTQSKVDLERQMYILRKLSMVAISSALNLDNDGIIDFYICSLSSRTVVYKGQLTPAQLKDYYFADLGNERFTSYMALIHSRFSTNTFPSWDRAQPMRVLGHNGEINTLRGNVNWMKAREGLLKCKELGLSENELKKLLPIVDANSSDSGAFDGVLEFLIQSGKSLPEAVMLMIPEAWQNDNNMDPQRKAFYEYFSALMEPWDGPALIAFTDGHYLGATLDRNGLRPGRFYVTHSGRVVMASEVGVVDIPLEDVSQKGRLNPGMMLLVDFEKHIVVNDDALKEQYSLARPYGEWLKKQKLELKDIVDSVHESERVPPSITGVMPASGDDVDMENMGIHGLLAPLKAFGYTVESLEMLLLPMAKDGTEALGSMGNDTPLAIMSNREKLTFEYFKQMFAQVTNPPIDPIREKIVTSTECMVGPEGDLTEITEEQCHRLSLKGPLLSIEEMEAIKKMNYRGWRSKVIDITYSKGRGKKGLEEALDRICAEAHDAISDGYTTLVLSDRAFSRKRVAVSSLLAVGAVHQHLVKTLERTRVALVIESAEPREVHHFCTLVGFGADAICPYLAVEAIWRLQVDGKIPPKANGEFYSKDELVKKYFKASNYGMMKVLAKMGISTLASYKGAQIFEALGLSSEVIERCFAGTPSRVEGATFKMLARDALQLHGLAFPSRVFSPGSAEAKALPNPGDYHWRKGGEIHLNDPLAISKLQEAARTNSIDAYKQYSKLIHELNKACNLRGLLKFKEAAVKVPLDEVEPASEIVKRFCTGAMSYGSISLEAHTALATAMNKIGGKSNTGEGGEQPSRMEPLSDGSKNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAETHQTLVANDLRGRTVLQTDGQIKTGRDVAIATLLGAEEFGFSTAPLITLGCIMMRKCHKNTCPVGIATQDPVLREKFAGEPEHVINFFFMIAEEMREIMSQLGFRTVNEMVGRSDMLEVDKEVIKSNEKLENIDLSLLLRPAAELRPEAAQYCVQKQDHGLDMALDNKLIGLSNAALVKGLPVYIESPIHNVNRAVGTMLSHEVTKKYHLNGLPTDTIHIRFNGSAGQSFGAFLCPGITLELEGDGNDYVGKGLSGGKIVVFPPKGSTFDPKQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKADKVDIVQRRVNLMAEEGINFVVNANIGHDPLHSLDRLREENNAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQ

SEQ ID NO: 14788 - protein, 2194 aa, Medicago truncatula
MSNSLSLTFTALNNPQINAISNPSARLRPLARVTRCSATCVERKRWLGTKLRSGGGLERIQLWESGGLGRLPKLRVAVKSSFSAVPDKPMGLYDPAFDKDSCGVGFVAELNGQSSRKTVTDALEMLVRMTHRGACGCEANTGDGAGILVALPHGFYQEVVDFQLPPQGNYAVGMFFLPKSGSRRKESKNIFTKVAESLGHKVLGWRSVPTDNTGLGKSAQLTEPVIEQVFLTPSSDSKVDLEKQMYILRKLSMVSITSALNLQSDGITDFYICSLSSRTVIYKGQLTPAQLGEYYYADLGNERFTSYMALIHSRFSTNTFPSWDRAQPFRVLGHNGEINTLRGNVNWIKAREGLLKCKELGLSENDLKKFLPIVDANSSDSGCFDGVLEFLLHSGKSLPEAVMMMIPEAWQNDKNMDPQRKAFYEYYSALMEPWDGPALISFTDGHYLGATLDRNGLRPGRFYVTHSGRVIMASEVGVVDIPPEDVCRKGRLNPGMMLLVDFEKQIVVNDDALKEQYSLARPYGDWLEKQKIELKDIVDSVHESDIVPPTISGVPPLSNDDVDMENMGIQGLLAPLKAFGYSVESLEILLLPMAKDGVEALGSMGNDTPLAVMSNREKLTFEYFKQMFAQVTNPPIDPIREKIVTSMRCMVGPEGDLTETTEEQCHRLSLKGPLLSTKEMEAIKKMNYRGWRSKVIDITYSKERGKKGLEEALDRICTEAHNAISEGYTTLVLSDRAFSKKRVAVSSLLAVGAVHQHLVKTLERTRVALMVESAEPREVHHFCTLVGFGADAICPYLAIEAIWRLQVDGKIPPKASGDFNSKDELVKKYFKASTYGMMKVLAKMGISTLASYKGAQIFEALGLSSEVIEKCFAGTPSRVEGATFEMLAQDALDLHELAFPSRNFSPGSAEAVALPNPGDYHWRKGGEVHLNDPLAIAKLQEAARTNSVEAYKQYSKIIHELNKACNLRGLLKFKDAASKVPISEVEPASEIVKRFCTGAMSYGSISLEAHTALATAMNKIGGKSNTGEGGEQPSRMEPLADGSRNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHAEHVLISGHDGGTGASRWTGIKSAGLPWELGLAETHQTLVANDLRGRTTLQTDGQLKTGRDVAIAALLGAEEYGFSTAPLITLGCIMMRKCHKNTCPVGIATQDPVLREKFAGEPEHVINFLFMVAEEMREIMSQLGFRTVNEMVGRSDMLEVDKEVVKGNAKLENIDLSLLLRPAAELRPEAAQYCVQKQDHGLDMALDNKLISLSNAALEKGLPVYIETPICNTNRAVGTMLSHEVTKRYNLAGLPADTIHIQFTGSAGQSFGAFLCPGITLELEGDSNDYIGKGLSGGKVVVYPPKGSNFDPKDNILIGNVALYGATRGEAYFNGMAAERFCVRNSGAQAVVEGVGDHGCEYMTGGTVVVLGKTGRNFAAGMSGGIAYVLDVDGTFQSRCNLELVDLDKVEEEEDIITLRMLIQQHQRHTNSLLAKEVLVDFDNLLPKFVKVFPREYKRVLASMKSDAASKDAVESAAEDVDEQDDEAQAVEKDAFEELKKLATASLNEKPSEAPKRPSQVTDAVKHRGFVAYEREGVQYRDPNVRLNDWNEVMMETKPGPLLKTQSARCMDCGTPFCHQENSGCPLGNKIPEFNELVYQNRWQEALERLLETNNFPEFTGRVCPAPCEGSCVLGIIENPVSIKNIECAIIDKAFEEGWMIPRPPVKRTGKRVAIVGSGPSGLAAADQLNKMGHIVTVFERADRIGGLMMYGVPNMKTDKVDIVQRRVNLMAEEGINFVVNANIGLDPLYSLERLREENDAIVLAVGATKPRDLPVPGRELSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAETKFGKDPRTYEVLTKRFVGDENGVVKGLEVVRVRWEKDETGKFQFKEIEGSEEIIEADLVLLAMGFLGPEATIAEKLGVERDNRSNFKADYGRFSTSVDGVFAAGDCRRGQSLVVWAISEGRQAAAQVDSYLTKEDHGIDGNQDEFVKRQQDLNKKHSKHTVMT

SEQ ID NO: 14789 - protein, 2165 aa, Phaseolus vulgaris
MSNALSFTLPALNNPQISAFNSPNKARLHLRSRVARCPASTVEKKRLFGAQVRSSGFDRIRLLQSGRLPKWRVAVRSAFSAVPEKPLGLYDPAMDKDSCGVGFVAELSGECNRRTVTDALEMLVRMTHRGACGCEANTGDGAGILVALPHVFYQEVVDFELPPQGKYAVGMFFLPKSENRRKESKKLFSKVAESLGHTVLGWRSVPTDNTGLGKSALQTEPVIEQVFLTPSAESKVDLERQMYILRKLSMAAITSALNLQNDGITDFYICSLSSRTVVYKGQLTPAQLRDYYFADLGNERFTSYMALIHSRFSTNTFPSWDRAQPMRVLGHNGEINTLRGNVNWMKAREGLLKCKELGLSENKLKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDICRKGRLNPGMMLLVDFEKHAVVNDDALKEQYSLARPYEDWLKNQKIELKDIVDSVPKSGRVPPPIAGVAPPSNDDEDMVNMGIHGLLAPLKAFGYSVESLEMLLLPMAKDGVEALGSMGNDTPLAVMSNREKLTFEYFKQMFAQVTNPPIDPIREKIVTSMQCMVGPEGDLTEITEEQCHRLSLKGPLLYTEEMEAIKKMNYRGWHSKVIDITYSKERGKGGLEEALDRICAEAHDAISEGYTTLVLSDRAFSRKRVAVSSLLAVGAVHQHLVKTLERTRVALIVESAEPREVHHFCTLVGFGADAICPYLAIETIWRLQVDGKIPPKSSGEFHSKEELVKKYFKASNYGMMKVLAKMGISTLASYKGAQIFEALGLSSKVIEKCFAGTPSRVEGATFETLARDAFQLHELAFPSRVFSPGSAEAVTLPNPGDYHWRKGGEVHLNDPLAIAKLQEAARTNSVDSYKQYAKFIHELNKACNLRGLLKFKETAVKIPIDEVEPASEIVKRFCTGAMSYGSISLEAHTALAMAMNKIGGKSNTGEGGEQPSRMEPLPNGTMNPKRSAIKQVASGRFGVSSYYLTNADELQIKMAQGAKPGEGGELPGHKVIGDIAVTRNSTAGVGLISPPPHHDIYSIEDLAQLIHDLKNANPTARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGRSDMLEVDKEVIKSNEKLENIDLSLLLRPAAELRPEAAQYCVQKQDHGLENALDNKLISLSNAALEKGLPVYIETPIYNVNRAVGTMLSHEVTKRYHLAGLPSDTIHIRFTGSAGQSFGAFLCPGITLELEGDSNDYVGKGLSGGKIVVYPPKGSNFDPKENIVIGNVALYGATQGEAYFNGMAAERFCVRNSGAKAVVEGVGDHGCEYMTGGTVVVLGETGRNFAAGMSGGIAYVLDLDGKFQSRCNLELVDLDKVEEEEDVYTLRMLIQQHQRHTNSLLANEVLDDFENLLPKFIKVFPREYKRVLASVKSEEASKDAVVQAAKDAEDQDDEAQAVEKDAFEELKKLATVSLNEKQSQAETPKRPSQVTDAIKHRGFVAYEREGVQYRDPNVRMADWNEVMEETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPSGLAAADQLNKMGHAVTVYERADRIGGLMMYGVPNMKSDKVDVVQRRVNLMAEEGVDFVVNANVGNDPLYSLDRLREENDAIVLAVGSTKPRDLPVPGRELSGVHFAMEFLHANTKSLLDSNLEDGSYISAKGKKVVVIGGGDTGTDCIGTSIRHGCSSIVNLELLPQPPPTRAPGNPWPQWPRIFRVDYGHQEAAAKFGKDPRSYEVLTKRFLGDENGVLKGLEVIRVCWEKDETGRFQFKEIEGSEEIIEADLVLLAMGFLGPEPTIAEKLGLDRDNRSNFKADYGRFSTNVKGVFAAGALRPGSVPGGVGHFRGTTSCGTGGQLPRQRR

SEQ ID NO: 14790 - protein, 2082 aa, Manihot esculenta
MAHRGACGCETNTGDGAGILVALPHDFYKEVAKDIGFDLPPPGGYAVGMFFLPTSDKRREESKNVFTKVAESLGHTVLGWRRVPTDNSGLGNAALQTEPVVEQVFLTPTPRSKADLEQQMYILRRVSMVAIRAALNMQHGGVKDFYICSLSSRTIVYKGQLKPIQLKDYYYADLGNERFTSYMALIHSRFSTNTFPSWDRAQPMRVLGHNGEINTLRGNVNWMKAREGLLKCKELGLSKNEMKKLLPIVDASSSDSGAFDGVLELLVRAGRSLPEAIMMMIPEAWQNDKNMDPHRKALYEYFSALMEPWDGPALISFTDGRYLGATLDRNGLRPGRFYVTRSGRVIMASEVGVVDIPPEDVLRKGRLNPGMMLLVDFEKHIVVDDEALKHQYSLARPYGEWLKRQKIELNDIVGSVLETDKAIPCIAGVVPTSNDDEGMENMGVHGLLAPLKAFGYTVEALEMLLLPMAKDGSEALGSMGNDAPLAVMSNREKLTFEYFKQMFAQVTNPPIDPIREKIVTSTECMIGPEGDLTETTEEQCHRLSLKSPLLSIEEMEAIKKMNYRGWRSKVLDITYSKDCGRKGLEETLDRICAEAHDAIKEGYTLLVLSDRAFSSKRVAVSSLLAVGAVHHHLVKKLERTRIGLIVESAEPREVHHFCTLVGFGADAICPYLAIEAIWRLQVDGKIPPKSTGEFHSKDELVKRYFKASNYGMMKVLAKMGISTLASYKGAQIFEALGLSSEVIEKCFAGTPSRVEGATFEMLASDALHLHELAFPTRVYPPGSAEAVALPNPGDYHWRKGGEIHLNDPLAIAKLQEAARANSVAAYKEYSRRIQELNKACNLRGLLKFKESDVKVPLDEVEPASEIVKRFCTGAMSYGSISLEAHTSLAIAMNKIGGKSNTGEGGEQPSRMEPLPNGSMNPKRSAIKQVASGRFGVSSYYLTNADELQIKMAQGAKPGEGGELPGHKVIGDIAVTRNSTAGVGLISPPPHHDIYSIEDLAQLIHDLKNANPGARISVKLVSEAGVGVIASGVVKGHADHVLISGHDGGTGASRWTGIKNAGLPWELGLAETHQTLVANNLRGRTVLQTDGQLKTGRDVAIAALLGAEEFGFSTAPLITLGCIMMRKCHKNTCPVGIATQDPVLREKFAGEPEHVINFFFMLAEELREIMSELGFRTVNEMVGRTDMLEVDKEVTKNNEKLENIDLSLLLRPAADLRPEADLRPEAAQYCVQKQDHGLDMALDNKLITLSKAALEKNLPVYIETPICNVNRAVGTMLSHEVTKRYHLAGLPADTIHVKLNGSAGQSLGAFLCPGITLELEGDSNDYVGKGLSGGKIVVYPPKGSLFDPKDNIVIGNVALYGATSGEAYFNGMAAERFCVRNSGARAVVEGVGDHGCEYMTGGTVVVLGKTGRNFAAGMSGGVAYVLDVDGNFHSRCNSELVDLDGVEEEEDIMTLRMMIQQHQRHTNSQLSREVLADFENLLPKFIKVFPRDYKRVLAKMKQEAALTELAVKEAEEKDEAELMEKDAFEELKKLAAASLNEKSSLKEVAETVKRPTLVNDAVKHRGFIAYEREGVRYRDPNVRMNDWNEVMEESEPGPLLKTQSARCMDCGTPFCHQENSGCPLGNKIPEFNELVYQNRWREAFDRLLETNNFPEFTGRVCPAPCEGSCVLGIIENPVSIKSIECAIIDKAFDEGWMVPRPPVKRTGKGVAIVGSGPAGLAAADQLNRMGHLVTVYERADRIGGLMMYGVPNMKTDKVDVVQRRVNLMAEEGINFVVNANVGIDPLYSLDKLREENDAIVLAVGATKPRDLPVPGRELSGVHFAMEFLHANTKSLLDSNLEDGNYISAKGKRVVVIGGGDTGTDCIGTSIRHGCSSIVNLELLPEPPRTRAPGNPWPQWPRIFRVDYGHQEAATKFGKDPRSYEVLTKRFIGDEHGNVKGLEVIRVHWEKDASGKFQFKEVEGSEETIEADLVLLAMGFLGPESNVAEKLGMERDNRSNFKAEYGRFSTSVEGVFAAGDCRRGQSLVVWAISEGRQAASQVDKYLMREEEEDVTVSTDSQDDLVKRRRDLTKRQQDSKHTVVT

SEQ ID NO: 14791 - protein, 2185 aa, Glycine max
MSCSLSFSRLYARSERTLPSENEKPRLNVRCPVRVTKFLGTRLRSSGKSLGSERFHVWQSEGPGRSPKLRVAVRSAMSAVPNKPLGLYDPAMDKDSCGVGFVAELSGESSRKTVTDALEMLVRMTHRGACGCEANTGDGAGIMVALPHQFYKEVVDFELPPPGKYAVGMLFLPTSNSRREESKNVFQKVAESLGHSVIGWRSVPTDNTGLGKSAVLTEPVIEQVFLTPSTQSKVDLERQMYILRKLSMVAITSALNLDNDGITDFYICSLSSRTIVYKGQLTPAQLKDYYFADLGNERFTSYMALIHSRFSTNTFPSWDRAQPMRVLGHNGEINTLKGNVNWMKAREGLLKCKELGLSENELKKLLPIVDANSSDSGAFDGVLEFLIQSGKSLPEAVMMMIPEAWQNDKNMDPQRKAFYEYFSALMEPWDGPALISFTDGHYLGATLDRNGLRPGRFYVTHSGRVVMASEVGVVDIPVEDVSRKGRLNPGMMLLVDFEKHIVVNDDALKEQYSLARPYGEWLKKQKLELKDIVDSVHESERVPPSITGVVPASGDDVDMENMGINGLLVPLKAFGYTVESLEMLLLPMAKDGTEALGSMGNDAPLAVMSNREKLTFEYFKQMFAQVTNPPIDPIREKIVTSTECMVGPEGDLTEITEDQCHRLSLKGPLLSIEEMEAIKKMNYRGWRSKVIDITYSKGRGKKGLEEALDRICAEAHDAISDGYTTLVLSDRAFSRKRVAVSSLLAVGAVHQHLVKTLERTRVALVIESAEPREVHHFCTLVGFGADAICPYLAVEAIWRLQVDGKIPPKTNGEFYSKDELVKKYFKASNYGMMKVLAKMGISTLASYKGAQIFEALGLSSEVIERCFAGTPSRVEGATFEMLARDALKLHELAFPSRVFSAGSAEAKALPNPGDYHWRKGGEIHLNDPLAISKLQEAARTNSKDAYEQYSKLIHELNKACNLRGLLKFKEAAVKVSLDEVEPASEIVKRFCTGAMSYGSISLEAHTALATAMNKIGGKSNTGEGGEQPSRMEPLSDGSRNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAETHQTLVANDLRGRTVLQTDGQIKTGRDVAIATLLGAEEFGFSTAPLITLGCIMMRKCHKNTCPVGIATQDPVLREKFAGEPEHVINFFFMIAEEMREIMSQLGFRTVNEMVGRSDMLEVDKEVIKSNEKLENIDLSFLLRPAAELRPEAAQYCVQKQDHGLDMALDNKLIGLSNAALEKGLPVYIESPIHNVNRAVGTMLSHAVTKKYHLNGLPTDTIHIRFNGSAGQSFGAFLCPGITLELEGDGNDYVGKGLSGGKIVVFPPKGSTFDPKKNIVIGNVALYGATSGEAYFNGMAAERFCVRNSGANAVVEGVGDHGCEYMTGGIVVVLGNTGRNFAAGMSGGIAYVLDMDGKFLSQCNHELVDLDKVEEEEDITTLRMLIQQHQRHTNSVLAKEVLPDFENLVPKFIKVFPKEYKRVLASTKSKEASKDAVESASNHGEEQDEIELVEEDAFEKLKKLATASINGKPSEAESSKRPSQVIDPVKHRGFVAYERESVQYRDPNARINDWNEVMKETKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKTDKVDIVQRRVNLMAEEGINFVVNANIGHDPLYSLDRLREENDAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVLWEKDETGRFQFKEIEGSEEILEADLVLLAMGFLGPEPTIAEKLGIERDNRSNFKAEYGRFSTSLKGVFAAGDCRRGQSLVVWAISEGRQAAAQVDSFLTNEDIEHNVAGSPDDKLQHKFAVPNKQ

SEQ ID NO: 14792 - protein, 2091 aa, Cajanus cajan
MGCDCVCACALQVTDALEMLVRMTHRGACGCEANTGDGAGILVALPHAFFKEVVDFELPPQGKYAVGMFFLPRSDKRREESKKIFSQVAESLGHSVLGWRSVRTDNTGLGKSALQTEPVIEQVFLTPSAQSKVDLERQMYILRKLSMVAITSALNLQNDGITDFYICSLSSRTVIYKGQLTPAQLRDYYFADLGDERFTSYMALIHSRFSTNTFPSWDRAQPMRVLGHNGEINTLRGNVNWMKAREGLLKCKELGLSENELKKLLPIVDANSSDSGAFDGVLEFLLHSGKTLPEAVMMMIPEAWQNDKNMDPQRKAFYEYFSALMEPWDGPALISFTDGHYLGATLDRNGLRPGRFYVTHSGRVIMASEVGVVDIPPADVCRKGRLNPGMMLLVDFEKHIVVNDDALKEQYSLARPYEDWLKRQKIELKDIVDSVHESERVPPPIAGVAPLSSDDTDMENMGIHGLLAPLKAFGYTVESLEMLLLPMAKDGVEALGSMGNDTPLAVMSNREKLTFEYFKQMFAQVTNPPIDPIREKIVTSMQCIVGPEGDLTEITEEQCHRLSLKGPLLSTDEMEAIKKMNFRGWRSKVIDITYSKELGKRGLEGALDRICAEAHDAINEGYTTLVLSDRAFSRKRVAVSSLLAVGAIHQHLVKTLERTRVALIVESAEPREVHHFCTLVGFGADAICPYLALEAIWRLQVDGKIPPKASGEFHSKDELVKKYFKASNYGMMKVLAKMGISTLASYKGAQIFEALGLSSEVIEKCFSGTPSRVEGATFKMLAHDAFQLHELAFPSRVFSPGSAEAVALPNPGDYHWRKGGEVHLNDPLAIAKLQEAARSNSVDAYKQYSKLIHELNKACNLRGLLKFKETAAKIPIDEVEPASEIVKRFCTGAMSYGSISLEAHTSLAMAMNKIGGKSNTGEGGEQPSRMEPLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGRSDMLDVDKEVVKSNEKLENIDLSLLLRPAAELRPEAAQYCVQKQDHGLDMALDNKLISLSNAALEKGLPVYIETPIYNVNRAVGTMLSHEVTKQYHLAGLPTDTIHIRFTGSAGQSFGAFLCPGITLELEGDSNDYVGKGLSGGKIIVYPPKGSNFDPKENIVIGNVALYGATCGEAYFNGMAAERFCVRNSGAKAVVEGVGDHGCEYMTGGTVVVLGETGRNFAAGMSGGTAYVLDMDGKFQSRCNLELVDLDSVEDEEDILTLRMLIQQHQRHTNSQLAKQVLDDFKNLLPKFIKVFPREYKRVLASMKSAETSKDGVAHAAKDKQEQDDEAQAVEKDAFEELKKLATASLNEKPSEAESPKRPSRVTGAIKHRGFVAYEREGVQYRDPNVRMTDWKEVMEETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPAGLAASDQLNKMGHTVTVYERADRIGGLMMYGVPNMKTDKVDIVQRRVNLMAEEGIDFVVNANVGHDPLYSLDRLREENDAIVLAVGATKPRDLPVPGRELSGVHFAMEFLHANTKSLLDSDLQDGNYISAKGKKVVVIGGGDTGTDCIGTSIRHGCTSIVNLELLPQPPPTRAPGNPWPQWPRIFRVDYGHQEAAAKFGKDPRSYEVLTKRFVGDENGVVKGLEVVRVRWEKDETGKFQFKEIEGSEEIIEADLVFLAMGFLGPEPTIAEKLGVERDNRSNFKADYGRFSTNVKGVFAAGDCRRGQSLVVWAISEGRQAAAWVDNYLVQDQDHRNPDELVKRPQGRNKKQQGSSKHTVMT

SEQ ID NO: 14793 - protein, 1519 aa, Cajanus cajan
MEALKRMNYRGWRSKVIDITYSKGRGKKGLEEALDRICAEAHDAISHGYTTLVLSDRAFSRKRVAVSSLLAVGAVHQYLVKTLERTRVALVIESAEPREVHHFCTLVGFGADAVCPYLAVEAIWRLQVDGKIPPKASGELYSKDELVKKYFKASIYGMMKVLAKMGISTLASYKGAQIFEALGLSSEVIERCFAGTPSRVEGATFEMLARVALQSHELAFPSRVFSPGSAEAIALPNPGDYHWRKGGEIHLNDPLAISKLQEAARTNSIDAYKQYSKLIHELNKACNLRGLLKFKEAAVKVPLDEVEPASEIVKRFCTGAMSYGSISLEAHTALATAMNKIGGKSNTGEGGEQPSRMEPLPDGSRNPKRSAIKQVASGRFGVSSYYLTNADELQIKMAQGAKPGEGGELPGHKVIGDIAVTRNSTPGVGLISPPPHHDIYSIEDLAQLIHDLKNANPAARISVKLVSEAGVGVVASGVVKGHADHVLISGHDGGTGASRWTGIKNAGLPWELGLAETHQTLVANDLRGRTVVQTDGQLKTGRDVAIAALLGAEEFGFSTAPLITLGCIMMRKCHKNTCPVGIATQDPVLREKFAGEPEHVINFFFMIAEEMREIMSQLGFRTVNEMVGRSDMLEVDKEVVKSNEKLENINLSLLLRPAAELRPEAAQYCIQKQDHGLDMALDNKLISLSRAALEKGLQVYIESPIYNVNRAVGTMLSHEVTKRYHLKGLPTDTIHIRFKGSAGQSFGAFLCPGITLELEGDGNDYVGKGLSGGKIVVYPPKVSTFDPEKNIVIGNVALYGATTGEAYFNGMAAERFCVRNSGAKAVVEGVGDHGCEYMTGGIVVVLGNTGRNFAAGMSGGIAYVLDMDGKFLSRCNSELVDLDKIEEEEDISTLRMLIQQHQRHTNSGLAKEVLANFENLLPKFIKVFPKEYKQVLATMKLKEATKNAAEPASKHREGQDEIELVEKDAFEELKKVATASLNGKPSQDEASKRPSQVSDPVKHGGFVAYEREGVQYRDPNARINDWKEVMMETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPAGLAAADQLNKMGHTVTVYERADRIGGLMMYGVPNMKADKVDIVQRRVNLMAEEGINFVVNANIGHDALYSLDRLREENDAIVLAVGATKPRDLPVPGRELSGVHFAMEFLHANTKSLLDSNLEDGNFISAKGKKVVVIGGGDTGTDCIGTSIRHGCTSIVNLELLPQPPQTRAPGNPWPQWPRIYRVDYGHQEGAAKFGKDPRSYEVLTKRFVGDENGVLKGLEVVRVRWEKDETGKFQFKEIEGSEEIIEADLALLAMGFLGPESTIAEKLGIERDNRSNLKAEYGRFSTSVRGVFAAGDCRRGQSLVVWAISEGRQAAAQVDSYLTNEDIEHGIAGNPDELIKKQQDLTKRGTVAVANKQ

SEQ ID NO: 14794 - protein, 2065 aa, Echinacea purpurea
CGCETNTGDGAGILVGLPHEFFKEVAKDEGFELPPLGQYAVGMFFLPTSDTRREQSKIVFTKVAESLGHTVLGWRTVPTDNSGLGKSAVQTEPVIEQVFLTPTSRSKVDFERQMYILRRVSMVAIRAALNLQHGGVKDFYICSLSSRTVVYKGQLKPNQLKEYYHADLGNERFTSYMAMIHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPQRKALYEYCSALMEPWDGPALVSFTDGRYLGATLDRNGLRPGRFYVTHSGRVIMASEVGVVDIPPEDVARKGRLNPGMMLLVDFDKHIVVDDEALKQQYSLARPYGKWLETQKIELKKIVESVNKSLRSCPPIAGVSKAEEDMGIQGLLAPLKAFGYTIESLEMLLLPMAKDGVEALGSMGNDAPLAVMSNREKLTFEYFKQMFAQVTNPPIDPIREKIVTSMECMVGPEGDLTETTEEQCHRLSLKGPLLSIEEMESIKNMNYRGWRSKVLDITYPKELGKKGLEETLDRICSQAHDAIKEGYTTLVLSDRAFSSKRVAVSSLLAVGAVHHHLVKKLERTRVALMVESAEPREVHHFCTLVGFGADAICPYLAVEAIWRLQADGKIPPKSNGEFHTKEELVKKYYKASHYGMQKVLAKMGISTLASYKGAQIFEAVGLSTDVMERCFAGTPSRVEGATFEALAGDALNLHDLGFPARKFPPNSAEAVALPNPGDYHWRKGGEIHLNDPLAIAKLQEAARGNSVAAYKEYSKRIHELNKTCNLRGLLKFKEGNAKVPLEEVEPASEIVKRFCTGAMSYGSISLEAHTTLAIAMNKIGGKSNTGEGGENPSRLVSLPDGSMNPKRSAIKQVASGRFGVSSYYLTNADELQIKMAQGAKPGEGGELPGHKVIGDIAVTRNSTAGVGLISPPPHHDIYSIEDLAQLIHDLKNANPSARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEMREIMADLGFRTVNEMVGRADMLEVDKDLTKDNEKLGNIDLSLLLRPAADIRPDAAQICVQKQDHGLDMALDQRLIPLAKPALEKGLPVYIESPICNVNRAVGTMLSHEVTKRYHLAGLPADTIHIKLNGSAGQSIGAFLCPGILLELEGDSNDYVGKGLSGGKIVVYPPKGSGFDPKENIVIGNVALYGATSGEAYFNGMAAERFCVRNSGANAVVEGVGDHGCEYMTGGTVVILGKTGRNFAAGMSGGIAYVLDVDAKFRLRCNAELVDLDKVEDEDDIMTLRMMIQQHQRYTNSQLAKEVLADFDNLLPKFIKVFPRDYKRILATMKEKENAKNAAAEMAPEEADIREEDELKEKDAFEELKKLAAKALSEAVNINVKEMVNEVKEVEMAEPATRPSRVEDAVKHRGFVAYEREGVSYRDPAVRMEDWNEVMEETKPGPLLKTQSARCMDCGTPFCHQDNSGCPLGNKIPEFNELVYQNRWREALDRLLETNNFPEFTGRVCPAPCEGSCVLGIIENPVSIKSIECSIIDKAFEEGWMVPRPPLKRTGKKVAIVGSGPAGLAAADQLNRLGHTVTVFERADRIGGLMMYGVPNMKADKIDVVQRRVDLMAEEGVNFVVNANVGTDPSHSIERLHEENDAVILAVGSTRPRDLPVPGRELSGIHFAMEFLHANTKSLLDSNLEDGNYISAKGKKVIVIGGGDTGTDCIGTSIRHGCTSIVNLELLPQPPQTRAPGNPWPQWPRVFRVDYGHQEAATKFGKDPRTYEVLTKRFISDDNGSVKGVEVVRVQWAKDETGQFKFKEVEGSEEILEADLVLLAMGFLGPESTIADKLGLEKDGRSNVKAEYGRFSTSVEGVFAAGDCRRGQSLVVWAISEGRQAAAQVDKFLSKDEKDVESRLEKGKREQQAVRTL

SEQ ID NO: 14795 - protein, 2202 aa, Cicer arietinum
MSNTASVTFTALNNPQINAIRNPNGRLRPLASVRSRVTRCSATCVEKKRWLGTRLRGSGSDRVQFWESGGPGRLPKLRVAVKSSFSAVPEKPMGLYDPAMDKDSCGVGFVAELNGQSSRKTITDALEMLVRMTHRGACGCEANTGDGAGILVALPHAFYQEVLDFQLPPQGKYAVGMFFLPKSDSRRKESKNIFKKVAASLGHTVLGWRSVPTDNTGLGKSALQTEPVIEQVFITPSSHSKVDLEKQMYILRKLSMAAITSALNLQNDGITDFYICSLSSRTVIYKGQLTPAQLGDYYNADLGNERFTSYMALVHSRFSTNTFPSWDRAQPFRVLGHNGEINTLRGNVNWIKAREGLLKCKELGLSEDDLKKFLPIVDANSSDSGCFDGVLEFLLHSGKSLPEAVMMMIPEAWQNDKNMDPQRKAFYEYYSALLEPWDGPALISFTDGHYLGATLDRNGLRPGRFYVTHSGRVIMASEVGVVDIPPEDVCRKGRLNPGMMLLVDFEKHIVVNDDALKEQYSLARPYGDWLKNQKIELKDIVDSVHESDIVPPTITGVAPLSNDDVDMGNMGIHGLLAPLKAFGYSVESLEMLLLPMAKDGVEALGSMGNDTPLAVMSNREKLTFEYFKQMFAQVTNPPIDPIREKIVTSMQCMVGPEGDLTETTEEQCHRLSLKGPLLTTKEMEAIKKMNYRGWRSKVIDITYSKERGKKGLEEALDRICTEAHNAIDEGYTTLVLSDRAFSRKRVAVSSLLAVGAVHQHLVKTLERTRVALMVESAEPREVHHFCTLVGFGADAICPYLAVEAIWRLQVDGKIPPKASGEFHSKDELVKKYFKASNYGMMKVLAKMGISTLASYKGAQIFEALGLSSEVIEKCFAGTPSRVEGATFEMLAHDALHLHELAFPSRVFSPGSAEAVALPNPGDYHWRKGGEVHLNDPLAIAKLQEATRTNSVEAYKQYSKTIHELNKACNLRGLLKFKETSCKISIDEVEPASEIVKRFCTGAMSYGSISLEAHTALATAMNKIGGKSNTGEGGEQPSRMEPLADGSRNPKRSAIKQVASGRFGVSSYYLTNADELQIKMAQGAKPGEGGELPGHKVVGDIAVTRNSTAGVGLISPPPHHDIYSIEDLAQLIHDLKNANPAARISVKLVSEAGVGVIASGVVKGHAEHVLISGHDGGTGASRWTGIKNAGLPWELGLAETHQTLVANDLRGRTTLQTDGQLKTGRDVAIATLLGAEEFGFSTAPLITLGCIMMRKCHKNTCPVGIATQDPVLREKFAGEPEHVINFFFMVAEEMREIMAQLGFRTVNEMIGRSDMLEVDKEVIKGNAKLENIDLSLLLRPAAELRPDAAQYCVQKQDHSLDMALDNKLISQSNAALEKGLPVYIETPICNTNRAVGTMLSHEVTKRYNLAGLPSDTIHIQFTGSAGQSFGAFLCPGITLELEGDSNDYIGKGLSGGKIVVYPPKGSTFDPKDNIIIGNVALYGATRGEAYFNGMAAERFCVRNSGAQAVVEGVGDHGCEYMTGGTVVVLGKTGRNFAAGMSGGIAYVLDVDGTFQSRCNLELVDLDKVEEEEDIITLRMLIQQHQRHTNSALAKEVLVDFENVVPKFVKVFPREYKRVLASIKSDATSKDAVESAAKDVDGQDDESQAVEKDAFEELKKLATASLNEKPSEAPKRPSQVIDAVKHRGFVAYEREGVQYRDPNVRLNDWKEVMMETKPGPLLKTQSARCMDCGTPFCHQENSGCPLGNKIPEFNELVYQNRWQEALDRLLETNNFPEFTGRVCPAPCEGSCVLGIIENPVSIKNIECAIIDKAFEEGWMVPRPPVKRTGKRVAIVGSGPSGLAAADQLNKMGHTVTVFERADRIGGLMMYGVPNMKTDKVDIVQRRVNLMAEEGVNFVVNANIGHDPLYSLERLREENDAIVLAVGATKPRDLPVPGRQLSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAESKFGKDPRTYEVLTKRFVGDENGAVKGLEVVHVRWEKDETGKFQFKEIEGSEEIIEADIVLLAMGFLGPESNIAEKLGVERDNRSNFKADYGRFSTNVNGVFAAGDCRRGQSLVVWAISEGRQAAAQVDSYLTKEDQDHNIDGNQDEFVKRQKDLNKKHQDSGIHTVMT

SEQ ID NO: 14796 - protein, 2077 aa, Manihot esculenta
MSHRGACGCETNTGDGAGILVALPHHFYKEVAKDMGFELPPPGEYAVGMFFLPTSDSRREESKNVFAKVAESLGHTVLGWRQVPTDNSGLGKSALQTEPVVEQVFLTPSPRSKADLEQQMYILRRVSMVAIRAALNLQHGGVRDFYICSLSSRTVVYKGQLKPIQLKEYYYADLGNERFTSYMALIHSRFSTNTFPSWDRAQPMRVLGHNGEINTLRGNVNWMKAREGLLKCKELGLSKNEMKKLLPIVDASSSDSGSFDGVLELLVRAGRSLPEAIMMMIPEAWQNDKNMDPHRKALYEYFSALMEPWDGPALISFTDGRYLGATLDRNGLRPGRFYVTRSGRVIMASEVGVVDIPPDDVLRKGRLNPGMMLLVDFENHIVVDDEALKQQYSLARPYGEWLNRQKIELNDIVGSVPVADLAIPPIAGAVTTSNDDDNMENMGINGLLAPLKAFGYTVEALEMLLLPMAKDGAEALGSMGNDAPLAVMSNREKLTFEYFKQMFAQVTNPPIDPMREKIVTSMECMIGPEGDLTETTEEQCHRLSLKGPLLAVEEMEAIKKMNYRGWRSKVLDITYSKDHGRKGLEETLERICAEARDAISKGYTLLVLSDRAFSSNRVAVSSLLAVGAVHQHLVKKLERTRVGLIVESAEPREVHHFCTLVGFGADAICPYLAIEAIWRLQVDGKIPPKATGEFHSKDEVVKKYFKASNYGMMKVLAKMGISTLASYRGAQIFEALGLSSEVIEKCFAGTPSRVEGANFEMLARDALHLHELAFPTRVYPPGSAESVALPNPGDYHWRKGGEIHLNDPLAIAKLQEAARANSVAAYKEYSRHIQELNKACNLRGLLKFKEAEVKVPLDEVEPASEIVKRFCTGAMSYGSISLEAHSTLAIAMNKIGGKSNTGEGGEQPSRMEPLPNGSMNPKRSAIKQVASGRFGVSSYYLTNADELQIKMAQGAKPGEGGELPGHKVIGDIAVTRNSTAGVGLISPPPHHDIYSIEDLAQLIHDLKNANPGARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGKPEHVINFFFMLAEEVREIMSDLGFCTVNEMVGRSDMLEVDKEVTKNNEKLENIDLSLLLRPAADIRPEAAQYCVQKQDHGLDMALDNKLIELSRAALEKSLPVYIETPICNVNRAVGTMLSHEVTKRYHLNALPADTIHVKLNGSAGQSLGAFLCSGIFLELEGDSNDYVGKGLSGGKIVVYPPSGSLFDPKDNIVIGNVALYGATDGEAYFNGMAAERFCVRNSGARAVVEGVGDHGCEYMTGGTVVVLGKTGRNFAAGMSGGIAYVLDVEGKFHSRCNPELVDLDKVEEEEDITTLRMMIQQHQRHTNSQLAREVLADFESLLPKFIKVFPKDYKRVLANMKEAAALKEVAVEENEDLNEAELMEKDAFEELKKLAAASLNKKSSQVEAAEAVERPIVVNDAVKHRGFIAYERAGVQYRDPSIRMNDWKEVMQESKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFQEGWMVPQPPLRRTGKRVAIVGSGPAGLAAADQLNRMGHLVTVYERADRIGGLMMYGVPNMKTDKVDIVQRRVNLMAEEGINFVVNANVGIDHLYSLDRLREENDAIVLAVGATKPRQDMKQDLPVPGRELSGVHFAMEFLHANTKSLLDSNLEDGNYISAKGKKVVVIGGGDTGTDCVGTSIRHGCSRIVNLELLPEPPRTRAPGNPWPQWPRIFRVDYGHQEASTKFGKDPRSFEVLTKRFIGDEHGRVKGLELVRVHWEKDASGKFQFKEVEGTEETIEADLVLLAMGFLGPEPNVADKLGLERDNRSNFKAEYGRFSTSVEGIFAAGDCRRGQSLVVWAISEGRQAASQVDKYLMREDEAAISADNQGDLVESDIAKRQQDSKHTIMT

SEQ ID NO: 14797 - protein, 2123 aa, Glycine max
MSNALSFTLPALNNPQLNALNSPNKARLRHGLRIRVVASCIERKRFLGTRVRPSGSDRIWLLQSGRVPKLRVAVRSAFSAVPEKPLGLYDPAMDKDSCGVGFVAELSGESSRKTVTDALEMLVRMTHRGACGCEANTGDGAGILVALPHVFYQEVVDFELPPQGKYAVGMLFLPKSEKRREESKKMFSKVAESLGHTILGWRSVPTDNAGLGKSALQTEPVIEQVFLTPSAKSKVDLERQMYILRKLSMAAITSALNLQNDGITDFYICSLSSRTVVYKGQLTPAQLRDYYFADIGNERFTSYMALIHSRFSTNTFPSWDRAQPMRVLGHNGEINTLRGNVNWMKAREGLLKCKELGLSENELKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDVRRKGRLNPGMMLLVDFEKHIVVNDDALKEQYSLARPYEDWLKRQKIELKDIVNSVDESERVPPPIAGVAPLSNDDADMENMGIHGLLAPLKAFGYTVESLEMLLLPMAKDGVEALGSMGNDTPLAVMSKREKLTFEYFKQMFAQVTNPPIDPIREKIVTSMQCMVGPEGDLTEITEEQCNRLSLKGPLLSTEEMEAIKKLNYKGWRSKVIDITYSKECGKRGLEEALDRICAEAHHGISEGYTTLVLSDRAFSKKRVAVSSLLAVGAVHQHLVKNLERTRVALIVESAEPREVHHFCTLVGFGADAICPYLAVDAIWRLQVDGKIPPKASGEFHSKDELVKKYFKASNYGMMKVLAKMGISTLASYKGAQIFEALGLSSEVIAKCFAGTPSRVEGATFEMLARDAFQLHELAFPSWVFSPGSAEAVALPNPGDYHWRKGGEVHLNDPLAMAKLQEAARTNSVDAYKQYSKLIHELNKACNLRGLLKFKETAVKIPIDEVEPASEIVKRFCTGAMSYGSISLEAHTALAMAMNKMGGKSNTGEGGEQPSRMEPLPNGSMNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGHSDMLEFDKDVVKSNEKLENIDLSLLLRPAAELRPEAAQYCVQKQDHGLDMALDNKLISLSNAALEKGLPVYIETPIYNVNRAVGTMLSHEVTKRYHLAGLPTDTIHVRFTGSAGQSFGAFLCPGITLELEGDSNDYVGKGLSGGKIVVYPPKESNFDPKENIVIGNVALYGATCGEAYFNGMAAERFCVRNSGAKAVVEGVGDHGCEYMTGGTVVVLGKTGRNFAAGMSGGIAYVLDVDGKFQSRCNLELADLDKVEEEEDILALRMLIQQHQRHTNSLLAKEVLDDFENLLPKFIKVFPREYKRVLASMKSEETSKDALVHAAKDDQDDEAQAVEKDAFEELKKLVMASLNEEPSQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPSGLAAADQLNKMGHTVTVYERADRIGGLMMYGVPNMKTDKVDIVQRRVNLMAEEGIDFVVNANVGHDPLYTLDRLRGENDAIVLTVGATKPRDLPVPGRELSGVHFAMEFLHANTKSLLDSNLQDGNYISAKGKKVVVIGGGDTGTDCIGTSIRHGCSSVVNLELLPQPPPTRAPSNPWPQWPRIFRVDYGHQEAAAKFGKDPRSYEVLTKRFIGDENGVVKGLEVIRVCWEKDETGKFQFKEIEGSEEIIEADLVLLAMGFLGPESTIAEKLGVERDNRSNFKADYGRFSTNVKGVFAAGDCRRGQSLVVWAISEGRQAAAQVENYLIKEDQDHRNQDGLVKRQQGLNMKQQGSNKHTVMT

SEQ ID NO: 14798 - protein, 2138 aa, Musa acuminata
MAAVPGSAIKLQNQSVALPSVVNHKRNVCRGGRAARFAAYRRAQAVSLESQFLGAKLRASERVQRWRIDGPGRSPKLRVVSPSMALSQVPEKPLGLYDPSFDKDSCGVGFIAELSGEYSRKTVADSLEMLVRMAHRGACGCETNTGDGAGILVALPHGFFKEARILSFSIVTEDIGIQLPPPGQYAVGMFFLPTDDSRRKESKIVFTKVAESLGHVVLGWRPVPTDNRDLGESARQTEPLIEQVFLTPSPRSSADFEQQMYILRRVSMVAIRAALNLQHGGARDFYICSLSSRTVVYKGQLKPVQLKDYYYADLGDERFTSYMALVHSRFSTNTFPSWDRAQPMRVLGHNGEINTLRGNVNWMKAREGLLKCKELGLSKNEMKKLLPIVDASSSDSGAFDGVLELLVRAGRSLPEAVMMMIPEAWQNDKNMDPDRKALYEYFSALMEPWDGPALISFTDGRYLGATLDRNGLRPGRFYITHSGRVIMASEVGVVDIPPADVLRKGRLNPGMMLLVDFENRTVVDDEALKKQYSQARPYREWLKRQKICLDDIVNSIPKSDMIPPNIFGTVPSQNHDEDMENMGIRGLLAPLKAFGYTVEALDMLLLPMAKDATEALGSMGNDAPLAVMSNREKLSFEYFKQMFAQVTNPPIDPIREKIVTSMECMVGPEGDLTETTEEQCHRLSLKGPLLSIDEMESIKMMNYRGWRSKVLDITYPKKHGRKGLEETLNRICLEARAAIREGYTTLVLSDRGFSSERVAVSSLLAVGAVHQHLVSTLERTRIGLLVESAEPREVHHFCTLVGFGADAICPYLAMEAIWRYFKASNYGMMKVLAKMGISTLASYKGAQIFEALGLSSEVIEKCFKGTPSRVEGATFEMLAGDALCEVHLNDPLAIAKLQEAARANSVAAYKEYSRRIQELNKTCNLRGILKFKDVAEKVPLDEVESASEIVKRFCTGAMSYGSISLEAHSTLAIAMNKIGGKSNTGEGGEQPARMEPLSDGSRNPKRSAIKQVASGRFGVTSYYLTNADELQIKMAQGAKPGEGGELPGHKVIGDIAVTRNSTAGVGLISPPPHHDIYSIEDLAQLIHDLKNSNPGARISVKLVSEAGVGVIASGVVKGHADHVLISGHDGGTGASRWTGIKNAGLPWELGLAETHQTLVANDLRGRTVLQTDGQLKTGRDVAIAALLGAEEFGFSTAPLITLGCIMMRKCHKNTCPVGIATQDPVLREKFAGEPEHVINFFFMLAEEVREIMSQLGFRTINEMVGRADMLEIDKEVAKSNEKLGNIDLSLLLRPAADIRPGVAQYCIQKQDHGLEMALDQDLITSSKAALEKGLPVYVETPIRNVNRAVGTMLSHEVTKQYQLKGLPSDTIHIKLVGSAGQSLGAFLCPGITLELEGDSNDYVGKGLSGGKIVVYPPRESQFDPSENIVVGNVALYGATSGEAYFNGMAAERFCVRNSGARAVVEGVGDHGCEYMTGGTVVILGKTGRNFAAGMSGGIAYVFDVDGMFHTRCNPELVDLEKIEDGEDITTLRMMIQQHQRHTSSVLAREVLSNFDSLLPKFVKVFPRDYKRIVQNLKIEQAAKESEEQEEKELMEKDAFEELKKMAAASLNGKKAEGLAAAKRPTQVDNAVKHRGFIAYERQGISYRDPNDRIKDWKEVATESKPGPLMKTQSARCMDCGTPFCHQENSGCPLGNKIPEFNELVHQNRWREALDRLLETNNFPEFTGRVCPAPCEGSCVLGIIENPVSIKSIECAIIDKAFEEGWMVPRPPQKRTGKRVAIVGSGPAGLAAADQLNKMGHLVTVYERADRIGGLMMYGVPNMKADKVDVVQRRVDLMTREGVNFMVNANVGVDPMYSLNHLRAENDAIVLACGATKPRDLPVPGRELSGVHFAMEFLHANTKSLLDSNLQDGKYLSAKGKKVVVIGGGDTGTDCIATSIRHGCTNMINLELLPEPPQKRAPGNPWPQWPRIFRVDYGHQEASAKFGKDPRSYEVLTKRFVGDESGVVKGLEVVRVHWAKDSGGKFQFEEIKGSEEIIEADLVLLAMGFLGPELTIADQLGLERDNRSNFKAEYGHFSTSVDGVFAAGDCRRGQSLVVWAINEGRQAASQVDKYLMKDVNTCSKENPVSSEDLVHRVTA

SEQ ID NO: 14799 - protein, 778 aa, Solanum phureja
MGIAKTVQGSCWLLVFMLFFLFNLSDEFLEPSQSEAIVKIKQLLNFPQDLSSWSDNTDFCNSEPNTALTLMCYEDNITQLHISGYNWFPNLPQGFSTDTLFSNLALLPNLKVLSLVSLGLRGTLPKKIGFLSSLEIINISSNFFYGEIPGEISYLKSLQTLILDDNKFTGQVPEGVGLLHSLSVLSFKNNSFSGSLPNSLSNLQTLRILSISGNNFSGVVPNLHNLSNLQVLDLESNNLGPNFPNIPTKLVSLVLRKNKFSLGVPKELSSCYQLKKLDISSNELVGPFSPTILSLPSLSYLDISGNKLTGKLLKNVTCSQDLSFVNLSSNYLTGELPDCLHPSSGSKIVLFSGNCLSNKEQWQHPYSFCHNEALAVSIEPHKGKVKGGNGKAVLASSMVGGFVGVVAIVGLAFVVVRREYAKQKASKAPQTRLILEKVSPAHTLKLLNDARYISETRKLGLLGAPPYRTFVLDELREATNNFDISNLIGASSSGQIYKGRLTDGTVVAIKSIKMRKRHSVQSYTHQLGRISKIRYCHLVSTIGHCFECYQDDSSVSRICLVFEFVPNVTLRGVISGANSAQKFTWTQRMSAAIGIAKGIQFLHTGIVPGIFSNQLKITDVLLDQNFHVKISKYNLPLLIENKKMDTGPSSSGSKGNDGQRLKYEEKDDVYDFGVILLEIISGRTIDTKNDIDVSKDILIVSLTADEIARRNIIDPAVRKECSDSSLRTLMELCIKCLSDEPSQRPSVEDLIWNLQFAAQVQDPWNRDTYGNQESPGHV

SEQ ID NO: 14800 - protein, 777 aa, Nicotiana benthamiana
MRIANSMQCSLWFLVFIVFLLFNYSDEFLESSQYEAIEKIKLLLNFPQDLSSWSDNTDFCNSEPNTALTLVCYDDNITQLHVSGYNWFPNLPQGFSTDTLFSSLALLPNLKVLSLVSLGLRGTLPKNIGLLSSLEIVNISSNFFYGEIPGDISYLKSLQTLILDDNKFTGQVPEWVGSLPSLSVLSFKNNSFYGSLPNSLSNLQTLRILSLSANNFSGQVPNFQNLSNLQVLDLESNNLGPNFPTPPKKLASLVLRKNKFSLGLPNELSSCYQLKKLDISFNELVGPFSPTILSLPSLSFLDISGNKLNGKLLKNMTCSQELSFVNLSSNYLTGELPACLHPSSGSKVVLFSGNCLWNREQWQYPYSFCHNEALAVSIEPHKEKVKGGNGKAVLASSMVGGFVGGIAIIGLAFVVVRREYAKKKASKTPQTKLILEKVSPAHTLKLLNDARYISETRKLGLLGAPPYRTFVLDELREATNNFDISNLIGAGSNGQIYKGWLTDGTVVAIRSIKMRKRHSVQSYTHQLRRISKIRYCHLVSTIGHCFDCYQDDSSVSRICIVFEFVPNGTLRGVISEANSAQKFTWTQRMGAALGIAKGIQFLHTGIVPGIFSNQLKITDVLLDQNLHVKISKYNLPLLIENKMDTRLSSTGSKGNDGQRLINEEKNDVYDFGVILLEIIVGRTINTKNDIDVSKDILKVSLTADEIARRNIIDPAVQKECSDSSLRTLIELCIRCLSDEPSQRPSVEDLIWNLQFSAQVQDPWNRDTYGNQESPGHV

SEQ ID NO: 14801 - protein, 556 aa, Nicotiana benthamiana
MRIANSMQCSLWLLVFMVFLQFNYSHQFLESSQYEAIEKIKQLLNFPQDLSSWSDSTDFCNSEPNTALTLVCYDDNITQLHVSGYNLFPNLPQGFSTDTLFFNLALLPNLKVLSLVSLGLRGPLPRNIGLLSSLEIVNISSNFFYGEIPGEISYLKSLQTLILDDNKFTGQVPEWVGSLPSLSVLSFKNNSFYGSLPNSLSNLQTLRILSLSGNNFSGHVPNFQNLSNLQVLDLESNNLGPNFPTPPKTLASLVLRKNKFSLGLPKELSSCYQLKKLDISFNELVGPFSPSILSLPSLSYLDISGNKLTGKLLKNMTCSQELSFVNLLSNYLTGELPACLHPSSSSKVVLFSGNCLWNREQWQHPFSFCHNEALAVSIEPHKEKVKGGNGKAVLASSMVGGFVGGIAIIGLAFVVIRREYAKKKASKTPQTKLILVKVSPAHTLKLLNDARYISETRKLGLLGAPPYRTFVLDDLREATNNFDISNLIGAGSNGQMYKGRLTDGTVVAVRSIKMRKRHSVQSYTHQLGRISKIRYCHLVSTIGHCFDCYQDDSSVS

SEQ ID NO: 14802 - protein, 483 aa, Solanum tuberosum
VSENYNKKLLSKIATNDGHGENSAYFDGWKAYENDPFHPTQNPHGVIQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFSQPSFISISEVMSEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLEKSTFDNELKLWHIIINKVKLNVSPGCSFHCSEPGWFRVCFANMDDATMQVALKRIRHFVYLQPSKGVEVATKKQYCRTRSKLEISLSFRRLDDFMNSPHSPMSSPMVQARN

SEQ ID NO: 14803 - protein, 486 aa, Solanum phureja
MGLISENYNKNLLSKIATNDGHGENSAYFDGWKAYENDPFHPTQNPHGVIQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESYNNFKVTKEALEEAYKKAQESNIKVKGLLINNPSNPLGTILDKETLKDILRFINDKNIHLVCDEIYAATAFSQPSFISISEVMNEVVGCNDDLVHIVYSLSKDLGFPGFRVGIIYSYNDVVVNIARKMSSFGLVSTQTQRLIASMLSDTIFVENFIAKSAMRLSQRHDLFTIGLGQVGITTLKSNAGLFIWMDLRRFLEKSTFDDELKLWHIIINKVKLNVSPGCSFHCSEPGWFRVCFANMDDATMQVALKRIRHFVYLQPSKGVEVATKKQYCRTRSKLEISLSFRRLDDFMNSPHSPMSSPMVQARN

SEQ ID NO: 14804 - protein, 486 aa, Nicotiana benthamiana
MGFISGNNKLLSKIATSDGHGENSAYFDGWKAYENDPFHLIKNPNGVIQMGLAENQLCFDLIQEWVVNNPKASICTAEGAQDFKDIAIFQDYHGLPEFRKAVSRFMEKVRGDKVTFDPDHIVMSGGATGAHETLAFCLADPGDAFLVPTPYYPGFDRDLRWRTGVQLFPVVCESSNNFKVTKEALEFAYEKAQESNIRVKGLLINNPSNPLGTILDRETLKDILSFINDKNIHLVCDEIYAATVFSQPDFISISEVMQEVNGCNENLVHVVYSLSKDLGFPGFRVGIIYSYNNVVVNCARKMSSFGLVSTQTQFLIASMLSDEIFVENFIAKSSVRLSQRHCLFTKGLAQVGISTLKSNGGLFFWMDLRRLLKESTFEAELDLWHIIINEVKLNVSPGVSFHCSEPGWFRVCFANMDDETMRVALRRIRHFVLQRKGLIEVATKKPCRRRKLEISLSFRRLDDFMNSPFMNSPHSPMSSPMVQART

SEQ ID NO: 14805 - protein, 485 aa, Capsicum annuum
MEFISRNNQKQQLLSKIATNDGHGENSAYFDGWKAYANDPFHLTDNPNGVIQMGLAENQLCFDLIQEWVVNNPKASICTAEGAEDFQEIAIFQDYHGLPEFRQAVARFMEKVRGDRVTFDPNRIVMSGGATGAHEMLAFCLADPGDAFLVPTPYYPGFDRDLRWRTGVQLFPVVCESSNDFKVTRKALEEAYEKAQESNIKIKGLLINNPSNPLGTLLDKDTLRDIVTFINSKNIHLVCDEIYAATVFDQPRFISVSEVVDEMIGCNQDLIHIVYSLSKDLGFPGFRVGIVYSYNDTVVDIARKMSSFGLVSTQTQHLLASMLSDEIFIEKFIAESSERLGKRQGMFTKGLAQVGISTLKSNAGLFFWMDLRRLLKEPTFDAELELWRIIIHEVKLNVSPGVSFHCSEPGWFRVCFANMDDETMRTALRRIRNFVLQTKGLNNKVAVLKKQCSRSKLQISLSFRRLDDFMNSPANSPMNSPLVRT

SEQ ID NO: 14806 - protein, 484 aa, Nicotiana benthamiana
MVFISGKVQKQQLLSKIATNDGHGENSAYFDGWKAYENDPFHLSNNPNGVIQMGLAENQLCFDLIQEWVVNNPKASICTTEGAEDFKDIAIFQDYHGLPEFRQAVARFMEKVRGDKVTFDPNRIVMSGGATGAHETLAFCLANPGDAFLVPTPYYPGFDRDLRWRTGVQLFPVVCDSSNDFKVTKKALESAYEKAQESNINIKGLLINNPSNPLGTLLDSDTLKDIVTFINSKNIHLICDEIYAATVFDQPKFISVSEIVDEHVGCNKDLIHVVYSLSKDLGFPGFRVGIVYSYNDTVVNIARKMSSFGLVSTQTQHLIASMLSDEIFIEKFIAESSERLGKRHGMFTKGLAQVGISTLKSNAGLFFWMDLRRLLKESTFEAELELWRIIINEVKLNVSPGCSFHCSEPGWFRVCFANMDDETMRIALRRIRNFVLQTKGLNSKTAVKKQCSRSKLQISLSFRRMDDFMNSPVHSPMSSPLVRT

SEQ ID NO: 14807 - protein, 484 aa, Nicotiana benthamiana
MVFISGNVQKQQLLSKIATNDGHGENSAYFDGWKAYENDPFHLSNNPNGVIQMGLAENQLCFDLIQEWVVNNPKASICTTEGAEDFKDIAIFQDYHGLPEFRQAVARFMEKARGDKVTFDPNRIVMSGGATGAHETLAFCLANPGDAFLVPTPYYPGFDRDLRWRTGVQLFPVVCDSSNDFKVTKKALESAYEKAQESNINIKGLLINNPSNPLGTLLDSDTLRDIVTFINSKNIHLIFDEIYAATVFDQPKFISVSEIVEEHVGCNKDLIHIVYSLSKDLGFPGFRVGIIYSYNDTVVNIARKMSSFGLVSTQTQHLIASMLSDEIFVENFIAESSERLGKRHEMFTKGLAQVGISTLKSNAGLFFWMDLRRLLKESTFESELELWRIIINEVKLNVSPGCSFHCSEPGWFRVCFANMDDETMRIALRRIRNFVLQTKGFNSKTAFKKQCSRSKLQISLSFRRMDDFMNSPVHSPMSSPLVRT

SEQ ID NO: 14808 - protein, 484 aa, Solanum phureja
MVSISNNNNQKQQLLSKIATNDGHGENSPYFDGWKAYANDPFHLTDNPNGVIQMGLAENQLCFDLIQEWVVNNPKASICTAEGAENFQDIAIFQDYHGLPEFRQAVARFMEKVRGDRVTFDPDRIVMSGGATGAHEMLAFCLADPGDAFLVPTPYYPGFDRDLRWRTGVQLFPVVCESCNDFKVTKKALEEAYEKAQQSNIKIKGLLINNPSNPLGTLLDKDTLRDIVTFINSKNIHLVCDEIYAATVFDQPRFISVSEIVEEMIECNKDLIHIVYSLSKDLGFPGFRVGIVYSYNDTVVNIARKMSSFGLVSTQTQHLLASMLSDEIFIERFIAESSERLGQRQGMFTKGLAQVGISTLKSNAGLFFWMDLRRLLKEATFDGELELWRMIINEVKLNVSPGCSFHCSEPGWFRVCFANMDDETMKTALRRIRNFVLQTKGLNNIAAIKKQCSRSKLQISLSFRRLDDFNSPAHSPMNSPLVRT

SEQ ID NO: 14809 - protein, 483 aa, Nicotiana tabacum
MGFISSIDNELLSKVATNNGHGENSAYFDGWKAYEIDPFHPTQNSDGVIQMGLAENQLCFDLIQEWVVKNPKASICTAEGSQDFKDIAIYQDYHGLPEFRSAVARFMGKVRGDRITFEPERIVMSGGATGAHELLAFCLADPGEAFLVPTPYYPGFDRDLRWRTGVQLFPVVCESSNNFKVTKEALEAAYQKAQESNITVKGLLLNNPSNPLGTILDRETLKDTVRFINEKNIHLVCDEIYAATIFNKPDFISISEVIMEEDVECDRDLIHIVYSLSKDLGFPGFRVGIIYSYNDVVTNCARKMSSFGLVSTQTQFLISNMLSDENFVTKFIGESSERLQKRHGMFTRGLAQVGINTLKSNAGLFIWMDLRRLLKELTFEAELELWRIIINEVKLNVSPGCSFHCSEPGWFRVCFANMDDETMRIALRRINNFVIQRKGIEGGVKKLQCRRSKLEISLSFRKLDDFMNSPHSPMSSPLVQART

SEQ ID NO: 14810 - protein, 68 aa, Glycine max
MAGLLGYRSLPPKAKNLVVAGGLTAFVFGAYFYTMRAVGGTDELQVAIDKFEADKSKNEGDANMPSKV

SEQ ID NO: 14811 - protein, 68 aa, Vigna unguiculata
MAGLLGYRSLPPKAKNFVVAGGLTAFVFGAYFYTMRAVGGTDELQVAIDKFESDKSKKEGEANLPSKV

SEQ ID NO: 14812 - protein, 68 aa, Glycine max
MAGLLGYRSLPPKAKNLVVAGGLTAFVFGAYFYTMRAVGGTDELQVAIDKFEADKNKNAGDANMPSKV

SEQ ID NO: 14813 - protein, 68 aa, Cajanus cajan
MAGPLGYRSLPPKAKNLVVAGGLTAFVFGAYFYTMRAVGGTDELQVAIDKFEAAKSKSEADANLSSKV

SEQ ID NO: 14814 - protein, 68 aa, Glycine max
MAGLLGYRSLPPKAKNLVVVGGLTTFVFGAYFYTMRAVGGTNELQVAIDKFEANKNKNVGDANMRSKV

SEQ ID NO: 14815 - protein, 69 aa, Arachis hypogaea
MAGLSGFRSLPPKAKNLVVAGGLTAFVFGTYYYTMRAVGGTDELQVAIDKFEAEKSKTEGDGTSMPSKV

SEQ ID NO: 14816 - protein, 68 aa, Lotus japonicus
MAGVLGFASLPPKAKNFVVAGGLTAFVFGTYFYTMRAVGGTDELQVAIDKFEADKSKQEGEPSVPSKV

SEQ ID NO: 14817 - protein, 96 aa, Vigna unguiculata
MSLRRFLGFSDGEVMRSDAKPCSRLMRHTAGICSVGGALGFWILCRLHYGPRITNPRSLRWAACGAVTVSSSTALLVRLFSPECEPQNIAAYDNKK

SEQ ID NO: 14818 - protein, 96 aa, Arachis hypogaea
MSLRRFLGFSDGELMRSDAKPCSRLMRHTAGIYSVGGALGFWVLCRLHYGPRITIPRSLRWAACGAVTTSASTALLVRLFSPECEPQNIAAYDNKK

SEQ ID NO: 14819 - protein, 96 aa, Cicer arietinum
MSLRRFLGYSDGEVMRSDAKPCSRLMRHTAGIFSVGGALGFWVLCRMHYGPRITIPRSLRWAACGAVTVSSSTALLVRLFSPECEPQNIAAYDNKK

SEQ ID NO: 14820 - protein, 96 aa, Cajanus cajan
MSLRRFLGYSDGEVMRSDAKPCSRLMRHTAGIFSVGGALAFWVLCRMHYGPRITIPRSLRWATCGAVTVSSSTALLVRLFSPECEPQNIAAYDNKK

SEQ ID NO: 14821 - protein, 97 aa, Pisum sativum
MSLRRFLDYSDGEVMRPDAKPCSRLMRHTAGIFSVGGALGFWVLCRMHYGPRITVPRSLRWAACGAVTVSSSTALLVRLFSPECEPQNIAAYDNKKY

SEQ ID NO: 14822 - protein, 96 aa, Vaccinium corymbosum
MALRRFLGFSDGELMRSDAKPCSRLMRQTAGIFSVGGALGFWILCRLHYGPRITIPRSLRWAGCGAVSVSSTTALLVRLFSPECEPQNIAAYDNKK

SEQ ID NO: 14823 - protein, 96 aa, Glycyrrhiza uralensis
MSLRRFLGYSDGEVMRSDAKPCSRLMRHTAGIFSVGGALGFWVLCRMHYGPRVTIPRSLRWAACGAVTMSSSTALLVRLFSPECEPQNIAAYDIKK

SEQ ID NO: 14824 - protein, 96 aa, Lotus japonicus
MSLRGFLGLSEGEVMRSDAKPCSRLMRHTAGICSVGGALGFWILCRLHYGPRITVPRSLRWAACGAVTMSSSTALLVRLFSPECEPQNIAAYDTKN

SEQ ID NO: 14825 - protein, 96 aa, Glycine max
MSLRRFLGYSDGEVMRSDAKPCSRLMRHTAAIFSVGGALGFWVLCRMHYGPRITNPRSLRWAACGAVTASSGTALLVRLFSPECEPQNIAAYDNKN

SEQ ID NO: 14826 - protein, 96 aa, Trigonella foenum-graecum
MSLRRFLGYSDGDVMRSDCKPCSRLMRHTAGIFSVGGALGFWVLCRMHYGPRIHIPRSLRWAACGAVTVSSSTALLVRLFSPECEPQNIAAYDNKK

SEQ ID NO: 14827 - protein, 96 aa, Medicago truncatula
MSLRRFLGFSEGDVMRSDCKPCSRLMRHTAGIFSVGGALGFWVLCRMHYGPRIQIPRSLRWAACGAVTVSSSTALLVRLFSPECEPQNIAAYDNKK

SEQ ID NO: 14828 - protein, 96 aa, Valeriana officinalis
MALRRFFGFSDGELMRSDAKPCTRLMRQTAGIFTVGGALGFWVLCRLHYGPRITVPRSLRWAACGAVTVSSSTALLVRLFSPECEPQNIAAFDKKK

SEQ ID NO: 14829 - protein, 71 aa, Vaccinium corymbosum
MRQTAGIFSVGGALGFWILCRLHYGPRITIPRSLRWAGCGAVSVSSTTALLVRLFSPECEPQNIAAYDHKK

SEQ ID NO: 14830 - protein, 96 aa, Solanum lycopersicum
MALRRMLGYSDGELMRSDAKPCTRLMRQTAGIFSVGGALGFWILCRLHYGPRITVPRSLRWAACGAVTVSSSTALLVRLFSPECEPQNIAAYDKKG

SEQ ID NO: 14831 - protein, 96 aa, Coffea canephora
MALRRFLGFSDGELMRSDAKPCSRLMRQTAGIFSVGGALGFWVLCRLHYGPRITIPRSLRWAACGAITASSSTALLVRLFSPECEPQNIAAFDKKK

SEQ ID NO: 14832 - protein, 96 aa, Medicago truncatula
MSLRRFLGFSEGDVMRSDCKPCSRLMRHTAGIFSVGGALRFWVLCRMHYGPRIQIPRSLRWAACGAVTVSSSTALPVRLFSPECEPQNIAAYDNKK

SEQ ID NO: 14833 - protein, 96 aa, Sarracenia psittacina
MALRRFFGFSDGELMRSDAKPCSRLTRHTAGIFTVGGALGFWVLCRLHYGPRITIPRSLRWAGCGAVSVSSTSALLVRLFSPECEPQNIAAYDNKK

SEQ ID NO: 14834 - protein, 96 aa, Camellia sinensis
MALRRFFGFSDGELMRSDAKPCSRLMRQTAGIFTVGGGLGFWVLCRLHYGPRITVPRSLRWAACGAVSVSSTTALLVCLFSPECEPQNIAAYDNKK

SEQ ID NO: 14835 - protein, 96 aa, Panax ginseng
MALRRFFGFSEGELMRSDSKPCTRLMRQTAGIFSVGGALGFWVLCRLHYGPRITVPRSLRWAGCGAVSVSSSTALLVRLFSPECEPQNIAAYDTKK

SEQ ID NO: 14836 - protein, 96 aa, Prunus persica
MALRRFLGFSDGELMRSDAKPCSRLMRHTAGIFSVGGALGFWILCRLHYGPRITVPRSLRWAACGAVSMSSTTALLVRLFSPECEPQNIATYDKGN

SEQ ID NO: 14837 - protein, 96 aa, Solanum phureja
MALRRMLGYSDGELMRSDAKPCTRLMRQTAGIFSVGGALGFWILCRLHYGPRITVPRSLRWATCGAVTVSSSTALLVRLFSPECEPQNIAAYDKKG

SEQ ID NO: 14838 - protein, 96 aa, Solanum melongena
MALRRMLGYSDGELMRSDAKPCSRLMRQTAGIFSVGGALGFWILCRLHYGPRITVPRSLRWATCGAVSVSSSTALLVRLFSPECEPQNIAAYDKTG

SEQ ID NO: 14839 - protein, 96 aa, Lotus japonicus
MSLRRFLGHSEGEVMRSDAKPCSKLMRHTAGICSVGGALGVWILCRLHYGHRITIPRSLRWAACGAVTMSSSTALRVRLFSPKREPQNIAAYDTKK

SEQ ID NO: 14840 - protein, 96 aa, Olea europaea
MALRRVLGFSDGELMRSDAKPCSRLMRQTAGIFSVGGALGFWILCRLHYGPRITVPRSLRWATCGAVSTSATTALLVRLFSPECEPQNIAAYDKKK

SEQ ID NO: 14841 - protein, 96 aa, Citrus sinensis
MALRRFFGFSDGELMRSDAKPCSRLMRQTAGIFTVGGALGFWVLCRLHYGPRVTVPRSLRWAGCGAVSVSSTTALLVRLFSPECEPQNIAAYDRGK

SEQ ID NO: 14842 - protein, 113 aa, Vaccinium corymbosum
MALRRFLGFSDGELMRSDAKPCTRLMRQTAGIFSVGGALGFWILCRLHYGPRITIPRSLRWAGCGAVSVSSTTALLVRLFSPECEPQNITAYDHKNDVFLFVYYTLILKNEMT

SEQ ID NO: 14843 - protein, 98 aa, Sarracenia psittacina
MALRRFFGFSDGELMRSDAKPCSRLTRHTAGIFTVGGALGFWVLCRLHYGPRITVPRSLRWAGCGAVSVSSTSALLVRLFSPECEPQNIAAYDNKSDG

SEQ ID NO: 14844 - protein, 96 aa, Cichorium intybus
MALRRFFGFSDGELMRSDSKPCSRLMRHTAGVFSVGGALGFWILCRLHYGPRVHVPRSLRWASTGAVTVSAGTALLVRLFSPECEPQNIEAYDKKK

SEQ ID NO: 14845 - protein, 96 aa, Citrus clementina
MALRRFFGFSDGELMRSDAKPCSRLMRQTAGIFTVGGALGFWVLCRLHYGPRVTVPRSLRWAGCGAVSVSSTTALLVCLFSPECEPQNIAAYDRGK

SEQ ID NO: 14846 - protein, 96 aa, Lippia dulcis
MALRRMLGFSDGELMRSDAKPCSRLMRQTAGIFSVGGALGFWVLCRLHYGPRITVPRSLRWATCGAICMSSTTALLVRLFSPECEPQNIAAYDQKK

SEQ ID NO: 14847 - protein, 97 aa, Actinidia deliciosa
MALRRFLGFSDGELMRSDAKPCSRLTRHTAGICTFGGALGFWVLCRLHYGPRITIPRSLRWAGCGAVSVSSTGALLVRLFSPECEPQNIAAYDSKKR

SEQ ID NO: 14848 - protein, 96 aa, Ocimum basilicum
MALRRMLGFSDGELMRSDSKPCSRLMRHTAGICSVGGALGFWTLCRLYYGPRITVPRTLRWAACGAVSMSTTTALLVRLFSPECEPQNIAAYDQKK

SEQ ID NO: 14849 - protein, 96 aa, Malus domestica
MALRQVLGFSDGELMRSDCKPCSRLMRQTAGIFTVGGSLGFWILCRLHYGPRITVPRSLRWAACGAVSVSSSTALLVRLFSPECEPQNIATYDKGK

SEQ ID NO: 14850 - protein, 96 aa, Arnica chamissonis
MALRRLFGFSDGELMRSDSKPCSRLMRHTAGVFSVGGALGFWILCRLHYGPRVNVPRSLRWAGTGAVTVSATTALLVRLFSPECEPQNIEAYDKKK

SEQ ID NO: 14851 - protein, 96 aa, Artemisia annua
MALRRFLGFSDGELMRSDSKPCSRLMRHTAGVFSVGGALGFWILCRLHYGPRVNVPRSLRWAGAGAITVSASTALLVRLFSPECEPQNIEAYDKKK

SEQ ID NO: 14852 - protein, 96 aa, Beta vulgaris
MALRRALGWSDGELMRSDAKPCSRLMRQTAGIFTVGGAMGFWILCRLHYGPRVTIPRSLRWAACGGVSVSSTTALLVRLFSPECEPQNIAAYDNKR

SEQ ID NO: 14853 - protein, 96 aa, Manihot esculenta
MALRRFLGFSDGELMRSDAKPCSRLMRQTAGIFTVGGALGFWVLCRLHYGPRITVPRSLRWATCGAISVSSTTALLVRLFSPECEPQNIAAYDKIN

SEQ ID NO: 14854 - protein, 96 aa, Ricinus communis
MALRRFFGFSDGELMRSDCKPCSRLMRQTAGVFSVGGALGFWILCRLHYGPRITVPRSLRWATCGAISTSSTTALLVRLFSPECEPQNIAAFDRAK

SEQ ID NO: 14855 - protein, 96 aa, Euonymus alatus
MALRRFFGFSDGELMRSDAKPCSTLMRQTAAIFSVGGALGFWVLCRLHYGPRITTPRSLRWATCGAVSMSTTTALLVRLFSPECEPQNIAAYDRVK

SEQ ID NO: 14856 - protein, 96 aa, Vitis vinifera
MALRRLFGFSDGELMRSDAKPCSRLMKQTAGLFTVGGGFAFWILCRLHYGPRITVPRSLRWAACGAVSVSSSSALLVRLFSPACEPQNIAAYDNKK

SEQ ID NO: 14857 - protein, 96 aa, Carpinus betulus
MALRRFFGFSDGELMRSDAKPCSRLMRQTAGIFTVGGGLAFWILCRLHYGPRITVPRTLRWATCGAVSVSSTSALLVRLFSPECEPQNIAAYDKGK

SEQ ID NO: 14858 - protein, 96 aa, Unknown
  Sequence found in Organisms: Nicotiana benthamiana, Nicotiana tabacum
MALRRMLGYSDGELMRSDAKPCSRLMRQTAGIFSVGGALGFWVLCRLHYGPRITVPRSLRWATCGAISMSSSTALLVRLFSPECEPQNIAAYDKKG

SEQ ID NO: 14859 - protein, 96 aa, Quercus alba
MALRRFLGFSDGELMRSDSKPCSRLMRQTAGIFTVGGGLGFWILCRLHYGPRITVPRSLRWAACGAASVSSTTALLVRLFSPECEPQNIAAYDKGS

SEQ ID NO: 14860 - protein, 96 aa, Populus trichocarpa
MALRRLCGFSDGELMRSDCKPCSRLMRQTAGIFSVGGAFGFWILCRLHYGPRITNPRSLRWAACGAIAWSSTSALLVRLFSPECEPQNIAAYDKVK

SEQ ID NO: 14861 - protein, 96 aa, Prunus mume
MALRRFLGFSDGELMRSDAKPCSRLMRQTAGIFSVGGALGFWILCGLHYGPRITVPRTLRWAACGAVSMSSTTALLVRLFSPECEPQNIATYDKGN

SEQ ID NO: 14862 - protein, 80 aa, Flaveria ramosissima
MALRRMLGFSDGELMRSDAKPCSRLMRHTAGVFSVGGALGFWILCRLHYGPRVNVPRSLRWAGTGAITVSASTALLVRLF

SEQ ID NO: 14863 - protein, 89 aa, Fraxinus spp
GRGKERQKRKIYSSPLALIYPALQRFLLNFFVTELGSFCSALVGKIEYLEEHSKNGIKAHAWIFRWGTYEVRCKMLLQVDTANCWHFQC

SEQ ID NO: 14864 - protein, 79 aa, Tabernaemontana elegans
MQKPCSRLMKQTAEIFTVGGALGFWVLCRLHYGPRITVPRSLRWAACGAVTTSTTTALLVRLFSPECEPQNIAAFDTKK

SEQ ID NO: 14865 - protein, 96 aa, Vitis vinifera
MALRHLFGFSDGELMRSDAKPCSRLMKQTAGLFTVGGGFAFWILCRLHYGPRITVPRSLRWAACGAVSVSSSSALLVRLFSPACEPQNIAAYDNKK

SEQ ID NO: 14866 - protein, 95 aa, Amborella trichopoda
MALRRLFGFSDGELSRSDAKPCSRLMRHTAAIFSVGGALGFWTLCRLHYGPRITVPRSLRWAGSGAIGVSSTTALLVRLFSPECEPQNIAAYEKK

SEQ ID NO: 14867 - protein, 96 aa, Taraxacum officinale
MALRRFLGFSDGELMRSDSKPCSRLMRHTAGVFTVGGALGFWILCRLHYGPRVNVPRSLRWASTGAVTVSAGTALLVRLFSPECEPQNIEAYDKKK

SEQ ID NO: 14868 - protein, 96 aa, Mimulus guttatus
MSLRQMLGFSDGELMRSDAKPCTRLMRQTAGIFSVGGGLGFWVLCRLHYGTRITVPRSLRWAACGAVSTSATTALLVRLFSPECEPQNIAAYDHKK

SEQ ID NO: 14869 - protein, 96 aa, Carica papaya
MALRRLLGFSDGELMRSDAKPCSRLMRQTAAIFTVGGALGFWVLCRLHYGPRITVPRSLRWAGCGAISVSSTTALLVRLFSPECEPQNIAAYDKGK

SEQ ID NO: 14870 - protein, 96 aa, Sesamum indicum
MALRRMLGFSDGELMRSDAKPCSRLMRQTAGIFTVGGGLGFWVLCRLHYGPRITVPRSLRWAACGAISTSTTTALLVRLFSPECEPQNIAAYDRKK

SEQ ID NO: 14871 - protein, 96 aa, Helianthus annuus
MALRRMLGFSDGELMRSDAKPCSRLMRHTAGVFSVGGALGFWILCRLHYGPRVNVPRSLRWAGTGAITVSAGTALLVRLFSPECEPQNIEAYDKKK

SEQ ID NO: 14872 - protein, 96 aa, Tripterygium wilfordii
MALRRFFGFSDGELMRSDAKPCSTLTRQTAAIFSVGGALGFWVLCRLHYGPRITTPRSLRWAACGAVSVSTTTASLVRLFSPECEPQNIDAYDREK

SEQ ID NO: 14873 - protein, 98 aa, Centaurea maculosa
MALRRFFGFSDGELMRSDAKPCSRLMRHTAGVFSVGGALGFWILCRLHYGPRVNIPRSLRWAGTGAVTVSASTALLVRLFSAECEPQNIEAFDKKRKK

SEQ ID NO: 14874 - protein, 98 aa, Unknown
  Sequence found in Organisms: Centaurea maculosa, Cirsium arvense, Carthamus tinctorius
MALRRFFGFSDGELMRSDAKPCSRLMRHTAGVFSVGGALGFWILCRLHYGPRVNIPRSLRWASTGAVTVSASTALLVRLFSAECEPQNIEAFDKKRKK

SEQ ID NO: 14875 - protein, 97 aa, Unknown
  Sequence found in Organisms: Gossypium hirsutum, Gossypium raimondii
MALRRALGWSDGELMRSDAKPCSRLMRQTAGIFTVGGALGFWVLCRLHYGPRITVPRSLRWAACGAVSVSSASALLVRLFSPECESQNIAAYDKRKE

SEQ ID NO: 14876 - protein, 96 aa, Euonymus alatus
MALRRFLGFSDGELMRSDSKPCSILTRQTAGIFSVGGALGFWVLCRLHYGPRITTPRSLRWAACGAVSVSTTTALLVRLLSPECEPQNIAAFDGEK

SEQ ID NO: 14877 - protein, 96 aa, Orobanche aegyptiaca
MALRRMLGFSDGELMRSDAKPCSRLMSQTATIFSFGGALGFWVLCRLHYGPRITTPRSLRWAACGAVSMSATTALLVRLFSPECEPQNVAAYDQKK

SEQ ID NO: 14878 - protein, 101 aa, Cynara scolymus
MALRRFFGFSDGELMRSDAKPCSRLMRHTAGVFSVGGALGFWILCRLHYGPRVNVPRSLRWAGTGALTVSASTALLVRLFSAECEPQNIEAFDRRGKNNGQ

SEQ ID NO: 14879 - protein, 92 aa, Fraxinus spp
MLGFSDGELMRSDAKPCSRLTRQTAGIFSVGGALGFWILCRLHYGPRITVPRSLRWAACGAASTSATTALLVRLFSSECEPQNIVAYDKKKQ

SEQ ID NO: 14880 - protein, 104 aa, Helianthus annuus
MALRRMLGFSDGELMRSDAKPCSRLMRHTAGVFSVGGALGFWILCRLHYGPRVNVPRSLRWAGTGAITVSAGTALLVRLFSPECEPQNIEAYDKKNKIYISLRS

SEQ ID NO: 14881 - protein, 98 aa, Cirsium arvense
MALRRFFGFSDGELMRSDAKPCSRLMRHTAGVFSVGGALGFWILCRLHYGPRVNIPRSLRWAGTGALTVSASTALLVRLFSAECEPQNIEAFDKKRKK

SEQ ID NO: 14882 - protein, 121 aa, Amorphophallus konjac
NDSVESAREERRGGGDRWVVVVGAEWRCGGLGGLSDGEMMRSDAKPCSRLMRHTAAIYTVGGALGFWVLCRLHYGPRITVPRSLRWATCGAISMGSTTALLVRLFSPECEPQNIAAFDKVK

SEQ ID NO: 14883 - protein, 81 aa, Gossypium hirsutum
MALRRALGWSDGELMRSDAKPCSRLMRQTAGIFTVGGALGFWVLCRLHYGPRITVPEVFVGCLWSCVCQLGICFVGSPIQP

SEQ ID NO: 14884 - protein, 102 aa, Flaveria ramosissima
MALRRLFGFSDGELMRSDSKPCLRLMRHTAGIFSVGGALGFWILCRLHYGPRVNVPRSLRWAGTGAITASASTALLVNLFSPECEPQNIEAYDKKNSHLRVF

SEQ ID NO: 14885 - protein, 96 aa, Theobroma cacao
MALRRLLGWSDGELMRSDAKPCSRLMRQTAGIFTVGGALGFWVLCRLQHGPRITVPRSLRWAACGAVSVSSTSALLVRLFSPECEPQNVAAYDMGK

SEQ ID NO: 14886 - protein, 96 aa, Triphysaria pusilla
MALRRMLGFSDGELMRSDAKPCSRLMSQTATIFSFGGSLGFWVLCRLHYGPRITTPRSLRWAACGAVSMSATTALLVRLFSPECEPQNVAAYDQKK

SEQ ID NO: 14887 - protein, 96 aa, Triphysaria pusilla
MALRRMLGFSDGELMRSDAKPCSRLMSQTATIFSLGGSLGFWVLCRLHYGPRITIPRSLRWAACGAVSMSATTALLVRLFSPECEPQNVAAYDQKK

SEQ ID NO: 14888 - protein, 96 aa, Aristolochia fimbriata
MALRRFFGLTDGELMRSDAKPCTRLMRHTAGIYSVGGGLAFWVLCRLHYGPRITVPRTLRWAACGCITMSSTSALLVRLFSPECEPQNIAAYDKHG

SEQ ID NO: 14889 - protein, 96 aa, Musa acuminata
MALRRALGWSDGELMRSDAKPCTRLMRQTAGIFSVGGALAFWVLCRLHYGPRITNPRSLRWASCGAISVSSTSALLVRLFSPECEPQNIAAFDKPK

SEQ ID NO: 14890 - protein, 96 aa, Ipomoea nil
MALRQLCGFSDGEVMRSDCKTCSRLTRQTAAIFSVGGALGFWVLCRLHYGPRITNPRSFRWGACGAVSTSSTTALLVRLFSPECEPQNIAAYDKKG

SEQ ID NO: 14891 - protein, 96 aa, Tropaeolum majus
MSLRRCCGYSDGELMRSDAKPCSRLMRQTAGIFTVGGAIGFWVLCRLHYGPRVNKPRILRWAACGAVSVSSTTALLVRLFSPECEPQNIAAYDKGR

SEQ ID NO: 14892 - protein, 94 aa, Rhizophora mangle
MASRRFFGFSDGELMRSDCKPCSRLMRQTAGVFSVGGTLGFWILCRLHYGPRITLPRSLRWATCGAISVGSTSALLVRLFSPECEPQNIAAYDK

SEQ ID NO: 14893 - protein, 97 aa, Echinacea purpurea
MALRRLLGFSDGELMRSDSKPCSRLMRHTAGVFSVGGALGFWILCRLHYGPRVNVPRSLRWAGTGAITVSAGTALLVRLFSPECEPQNIEAYDKKSK

SEQ ID NO: 14894 - protein, 97 aa, Cucumis sativus
MALRRLLGFSDGEIMRSDAKPCSQLMKQTAGLCSVEGALGFWILCRLHYGPRITVRRSLRWAACGAASMSATSALLVRLFSPECEPQNIAAYDNRKL

SEQ ID NO: 14895 - protein, 99 aa, Citrullus lanatus
MALRRFLGFSDGELMRSDAKPCSQLMKQTAGLCTVGGGLAFWILCRLHYGPRITVPRSLRWAACGAVSMSATSALLVRLFSPECEPQNIAAYDKRKVVR

SEQ ID NO: 14896 - protein, 96 aa, Silene vulgaris
MALRRALGWSEGDLMRSDCKPCTRLMRQTAGIFTVGGALGFWVLCRLHYGSRVTIPRSLRWAACGAATVSSSTALLVRLLSPECEPQNIAAYDNIK

SEQ ID NO: 14897 - protein, 96 aa, Fragaria vesca
MALRRYLGFSDGELMRSDCKPCSRLMRQTAGIFTVGGAFGFWILCRLHYGPRITVPRALRWGACGALSVSSSTALLVRLLSPECEPQNIETYDKGK

SEQ ID NO: 14898 - protein, 283 aa, Glycine max
MACRGCWECLLKLFNFILTLTGLAIVGYGIYLFVEFSKASDDDNTPAISPVSDDSALIQLGRPVLMAVSLSNDFFDNLPRAWFIYLFIGIGVVLFLISCFGCIGAATRNGCCLSCYSILVALLILVELGCAAFIFFDKNWKEEIPTDKTGDFDAIYGFLIENWNIVKWVALGIVIFEALLFLLALIVRAANRPADYDSDEEFINPRQQVRQPLLNRPAASPATGLPVAGTMDQRPSRNDAWSTRMREKYGLDTSEFTYNPSESNRFQQVNSQPTEEKSRCTIM

SEQ ID NO: 14899 - protein, 283 aa, Phaseolus vulgaris
MACRGCWECLLKLLNFILSITGLAIVGYGIYLFVEFSKVSDDDTPDISPVSDDYALIQLGRPMLMAVSLSDSFFDNLPRAWFIFLFIGVGVVLFLISCFGCIGAATRNGCCLSFYSILVALLILIELGCAAFIFFDKNWKEEIPKDKTGDFDAIYGFLSENWNIVRWVALGIGIFQALLFLLALIVRAANRPADYDSDEEFINPRQQVRQPLLNRPAAGSTTTGLPVSGTIDQRPSRSDAWSARMREKYGLDTSEFTYNPSESSRFQQVNSQPTEEKSRCTIM

SEQ ID NO: 14900 - protein, 279 aa, Phaseolus vulgaris
MACRGCWECLLKLLNFILSLTGLAIVGYGIYLFVEFSKASDGETLTTSPVSDDSALIQLGRPVLMTVSLSNSFLDNLPSAWFIFVFIGIGVVLFLISCFGCIGAATRNGCCLSCYSILVVLLILIELGCAAFIFFDKNWKEEIPTDKTGDFDAIYEFLSENWNIVRWVALGIVVFEALLFLLALIVRAVNKPADYDSDEEFINPRQQPLLNRPAAAPVTGLPVAGTIDQRPSRNDAWSARMREKYGLDTSEFTYNPSESSRFQQVNSQSTEEKSRCTIM

SEQ ID NO: 14901 - protein, 283 aa, Glycine max
MACRGCWECLLKLFNFILTLTGLAIVGYGIYLFVEFSKASDDDNMPAISPVSDDSSLIQLGRPVLMAVSLSNDFFDNLPRAWFIYLFIGIGVVLFLISCFGCIGAAARNGCCLSCYSILVALLILVELGCAAFIFFDKNWKEQIPTDKTGEFDAIYGFLIENWNIMKWVALGIVIFEALLFLLALIVRAANRPADYDSDEEFINPRQQVQQPLLNRLPAGPATGIPVAGTIDQRPSRNDAWSTRMREKYGLDTSEFTYNPSESNRFQQVNSQPTEEKSRCAIM

SEQ ID NO: 14902 - protein, 282 aa, Vigna unguiculata
MACRGCWECLLKLLNFILSLTGLAIVGYGIYLFVEFSKASDDNSPDISPVSDDSALIQLGRPMLMAVSLSDSFLDNLPRAWFIFLFIGVGVVLFLISCFGCIGAATRNGCCLSCYSILVALLILIELGCAAFIFFDKNWKEEIPKDKTGDFDEIYGFLSDNWNIVRWVALGIGIFQVLLFLLALIVRAANRPADYDSDEEFINPRQQVRQPLLNRPTAGPTTGVPVTGTIDPRSSRSDAWSARMREKYGLDTSEFTYNPSESSRFQQVNPQPTEEKSRCTIM

SEQ ID NO: 14903 - protein, 281 aa, Cajanus cajan
MACRGCWECLLKLLNFILTLAGLGIVGYGIYLFVEFSKAADDDIPDISPVSDDSSLIQLGRPMLLAVSLSNSFFDNLPNAWFIYLFIGIGVVLFVISCFGCIGAATRNGCCLSCYSILVVLLILVELGCAAFIFFDKNWKEEIPTDKTGDFDVIYGFLRENWNIVKWFALGIVIFQAILFLLALIVRAANRPADYDSDEEFINPRQQARQPLLNRPAGTATGVPVAGTVDQRPSRNDAWSTRMREKYGLDTSEFTYNPSESHRFQQVNSQQTEEKSRCTIM

SEQ ID NO: 14904 - protein, 283 aa, Lotus japonicus
MACRGFWECLLKLFNFIMTLIGLTMVGYGIYLLVEFIKASGSDDDTPAVSPASDDQALIQLGRPMLLAVSLSESIFDKLPKAWFIYLFIGIGVVLFVISCFGCIGAGMRNGCCLCCYSILVALLILVELGCAAFIFFDKSWKEVVPSDKTGDFDTIYEFLRENWNIVKWVALGIVVFEVLLFLLALIVRASNRPADYDSDEEFINPRQQARQPLLNRPAGPATGPPASGTLDQRPSRNDAWSTRMREKYGLDTSEFTYNPSESQRFQQVNAPPTEERSRCTIM

SEQ ID NO: 14905 - protein, 278 aa, Arachis hypogaea
MACRGFWECLLKLLNFFLTLTGLAMVGYGIYLLVEFLQAPDDAVSPVSDDSSLIQLGRPMLTAVSLSNSFFDDLPKAWFIYIFIGIGVVLFAISCFGCIATSMRNGCCLSCYSVLLVLLILIELGCAAFIFFDKSWKEEIPTDKTGDFDMIYEFLRENWSIVKWVALGIVIFEALLFLLVLVVKAANRPADYDSDEEFINPRHQARQPLLNRTAGPATGVPVAGTLDHRPSRNDAWSTRMREKYGLDTSEFTYNPSESNRFQQPNSQPTEERSRCTIM

SEQ ID NO: 14906 - protein, 281 aa, Cicer arietinum
MACRGFWECLLKLLNFILTLTGLAMVGYGIYLFVGFTKASDDDIPEISPVSDDSALIQLGRPMLLAMSLSDSLFDKLPKAWFIYLFIGVGAVLFVVSCFGCIGAKTRNGCCLICYSILVALLILVELGCAAFLFFDKSWKQEIPTDKTGDFDMIYGFLRENWNIVRWVALGIVIFEALLFLLALIVRAVNRPVDYDSDDELIIQRQQVRQPLINRQTGPPTGLPVAGTTDQRPNRNDAWSTRMREKYGLDTSEFTYNPSESQRFQQVNSQPTEEKSRCTIM

SEQ ID NO: 14907 - protein, 280 aa, Cicer arietinum
MACRGFWECLLKLLNFLLTVTGLAMVGYGIYLLVEFSKASDSSLNVSTVSDGQTLVQLGRPLLMAVPLSDSFFDDLPKAWFIYLFIGVGAVLFVISCFGCIASVTRNGCCLSCYSVLVVLLILVELGCAAFVFFDKNWKEEIPRDKSGDFDMLYQFLRANWNIVKWVALGIVIFEALLFILALIVRAANRPADYDSDEEFINPRQQARQPLLNRPAGPAPGVPVTGPVDQRSSRNDAWSTRMREKYGLDTSEFTYNPSESHRFQQVNSQPTEERSRCTIM

SEQ ID NO: 14908 - protein, 280 aa, Medicago truncatula
MACRGCWECLLKLLNFILTITGLAMVGYGIYLLVEFSRASDNSMMLSAPSDDQTLVQLGRPMLMALPLSDNIFDNLPKAWFIYLFIGVGAVLFVISCFGCIASMTRNGCCLSCYSILVVLLILVELGCAAFIFFDKSWKEEIPRDKTGDFDMVYNFLRENWTIVKWVALGIVIFEALLFILALIVRAANRPVDYDSDEEFINPRQQARQPLLNRPAGPAPGVPVTGTTDPRSNRNDAWSTRMREKYGLDTSEFTYNPSESQRFQQVNSQPAEERSRCTIM

SEQ ID NO: 14909 - protein, 288 aa, Lotus japonicus
MACACRGCWECLLKLLNFLLTLVGLAMVGYGIYLLVEFSKASDNTLSVSTVSDDQTLVQLGRPMLMAVSLSNSFFDDLPKAWFIYLFIGIGVVLFVISCFGCIGAMTRSGCCLSCFAVLVVLLILAELGCAAFIFFDKSWKKASSAGNEIPTDKTGNFDMIYEFLRENWNIVRWVALGIVIFEALLFVLALIVRAANRPADYDSDEEFINPRQQARQPLLNRPAAPASGVPVAGTIDQRPSRNDAWSTRMREKYGLDTSEFTYNPSESQRFQQVNSQPTEERSRCAIM

SEQ ID NO: 14910 - protein, 289 aa, Medicago truncatula
MVCCRGFWECLLKLLNFILTVTGLAIVGYGIYLLVAFAKASDDDKPDISPTPDISPVSGDSALIQFGRPMLMAVSLSDNIFDKLPKAWFIYLFIGVGAVLFVVSCFGCIGATTRNGCCLICYSILVALLILVELGCAAFLFFDKSWKEEIPTDKTGDFDMIYGFLRENWDIVRWVALGIVIFEALLFLLALIVRAVNRPADYDSDDELINPRQQVRQPLLNNRQAGPPSGLPVAGTTDQRPNRNDAWSTRMREKYGLDTSEFTYNPSESQRFQQANSQPTEEKSRCTIM

SEQ ID NO: 14911 - protein, 277 aa, Glycine max
MACRGCWECLLKLLNFILTLAGLAMVGYGIYLFVEYNKTPDNTLTVGDDQTLVQLGRPMLVAVSLSNSFLDDLPKAWFIYLFIGIGAVLFVISCFGCIAALTRNGCCLSFYSVLVLLLILVELGCAAFIFFDKSWKEEIPTDKTGDFDMIYGFLRENWNIVRWVALGIVIFEALLFVLALIVRAANRPTEYDSDEEYINPRQQARQPLLNRPAGPVSGAPATGTLDQRPSRNDAWSTRMREKYGLDTSEFTYNPSESHRYQQVNSQPTEEGSRCAIM

SEQ ID NO: 14912 - protein, 282 aa, Lupinus angustifolius
MACCCKGFWECLLKLLNFILTLTGLAIVGYGIYLLVVFTKASGDTPAIPPVSDDRDLIRLGRPMLMAVSLSDSILDKLPKAWFIYVFIGIGVVLFVISCFGCIGAVTRSGCCLSFYSVLVVLLILAELGSAAFIFFDKSWKEEIPVDKTGAFDLIYGFLRENWNLVKWVALGIVIFEALLFFLALVVRAANRPADYDSDDEYINPRQQARQPLLNKPAGPATGVPVAGTIDQRPSRNDAWSTRMREKYGLDTSEFTYNPSESQRFQQVNSQPTEERSRCTIM

SEQ ID NO: 14913 - protein, 289 aa, Trigonella foenum-graecum
MVCCRGFWECLLKLLNFILTVTGLAIVGYGIYLLVGFTKASDDDRPDISPAPEISPLSDDSALIQFGRPMLMAVSLSDNIFDKLPKAWFIYLFIGVGAVLFIVSCFGCIGATTRNGCCLVCYSILVALLILVELGCAAFLFFDKSWKEEIPTDKTGDFDMIYGFLRENWDIVRWVALGIVIFEALLFLLALIVRAVNRPADYDSDDELINPRQQVRQPLLNNRQTGPPAGLPVAGTTDQRPNRNDAWSTRMREKYGLDTSEFTYNPSESQRFQQANSQPNEERSRCTIM

SEQ ID NO: 14914 - protein, 128 aa, Sorghum bicolor
MAKFNVVQKNRRQWKQDRKRAAHGEPGTGKLKQRTAPVSMSGKRKRKLERRLNREQKEAAMIKALENMGDVDMVSAEESSEAAKGKSQVKFSVKKNSRIQIKRLKGKGRKKAKNAKPPAKEKVDAMVE

SEQ ID NO: 14915 - protein, 129 aa, Cenchrus ciliaris
MAKFNVVQKNKRQWKQDRKRAAHGEPGTGKLKQRTAPVSMSGKRKRKLERRLNREQKEAAMIKALENNMGDVDMVSAEDSSEAAKGKSQVKFSVKKNSRIQIKRLKGKGRKKAKNAKPPTKDKVDTMVE

SEQ ID NO: 14916 - protein, 129 aa, Cenchrus ciliaris
MAKFNVVQKNKRQWKQDRKRAAHGEPGTGKLKQRTAPVSMSGKRKRKIERRLNREQKEAAMIKALENNMGDVDMVSAEDSSEAAKGKSQVKFNVKKNSRIQIKRLKGKGRKKAKNAKPPTKDKVDAMVE

SEQ ID NO: 14917 - protein, 129 aa, Setaria italica
MAKFNVVQKNKRQWKQDRKRAAHGEPGTGKLKQRTAPISMSGKRKRKIERRLNRDQKEAAMIKALENNMGDVDMVSAEESSEAAKGKSQVKVSVKKSSRIQIKRLKGKGRKKAKNAKPPTKGKVDAMVE

SEQ ID NO: 14918 - protein, 129 aa, Panicum virgatum
MAKFNVVQKNKRQWKQDRKRAAHGEPGTGKLKQRTAPVSMSGKRKRKLDRRLNREQKEAAMIKALENNMGDVDMVSAEESSEAAKGKPQVKLTVKKNSRVQIKRLKGKGRKKAKNAKPPTKDKVDSMVE

SEQ ID NO: 14919 - protein, 129 aa, Oryza sativa
MAKFNVVQKNRREWKQDRKRQAHGDPKTGKLKQRTAPVSVSGKRQRKLLRRLSREQKEAVMAKALENNMGDVEMVSAEGSSEAAKDKSQLKFNVKKNSRVQIKRLKGKGRKKAKNAKPPTKDKVDAMVE

SEQ ID NO: 14920 - protein, 461 aa, Zea mays
MASATTSISSHPAALRDVKAARIGGLRQQQASVAPSAAAARGQRARAVRSLRAAEPARQPVAASAAAAAPAAPVADEAAALAAVDYEALARELEGASPLEIMDRALAMFGSEIAIAFSGAEDVALIEYAKLTGRPFRVFSLDTGRLNPETYQLFDKVEKHYGIRIEYMFPDASEVQELVRTKGLFSFYEDGHQECCRVRKVRPLRRALKGLRAWITGQRKDQSPGTRASIPLVQVDPSFEGLDGGAGSLVKWNPVANVDGKDIWTFLRTMDVPVNTLHAQGYVSIGCEPCTRPVLPGQHEREGRWWWEDAKAKECGLHKGNIDKDAQAAAPRSANGNGSAGAPDIFESPAVVSLTRTGIENLLRLENRAEPWLVVLYAPWCPFCQAMEASYVELAEKLAGSGVKVAKFRADGEQKPFAQAELQLQSFPTVLLFPGRTARPIKYPSEKRDVDSLLAFVNSLR

SEQ ID NO: 14921 - protein, 458 aa, Setaria italica
MASATASISSHPAALRDVKAARIGAVRQQVAVAPSAAARGQRARAVRPLRAAEQGRQPVSASAASAAPVAPVADEAAAPAAVDYEALARELEGASPLQVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPLRRALKGLRAWITGQRKDQSPGTRASIPVVQVDPSFEGQDGGAGSLIKWNPVANVDGKDIWTFLRTMDVPVNTLHAQGYVSIGCEPCTRPVLPGQHEREGRWWWEDAKAKECGLHKGNIEKDGQAAPKSANGNGSAGAPDIFESPAVVSLTRTGIENLLGLENRAEPWLVVLYAPWCPFCQAMEASYVELAEKLADSGVKVARFRADGEQKPFAQAELQLQSFPTVLLFPSRTARPIKYPSEKRDVDSLLAFVNSLR

SEQ ID NO: 14922 - protein, 456 aa, Zea mays
MASATTSISSHPAALRDVKAARIGGALRQVGVAARGQRARAVPPLRAAEPARRPVAASAAAAPPAAPVADEAAVDYEALARELEGASPLEIMDRALAMFGSEIAIAFSGAEDVALIEYAKLTGRPFRVFSLDTGRLNPETYQLFDRVEKHYGIRIEYMFPDASEVQELVRTKGLFSFYEDGHQECCRVRKVRPLRRALRGLRAWITGQRKDQSPGTRASIPLVQVDPSFEGLDGGAGSLVKWNPVANVDGKDIWTFLRTMDVPVNALHAQGYVSIGCEPCTRPVLPGQHEREGRWWWEDAKAKECGLHKGNIDKDGQAAAAAAAPRTANGNGSAGAPDIFESPAVVSLTRAGVENLLRLESRAEPWLVVLYAPWCPFCQAMEASYVELAERLAGSGGVKVARFRADGEQKPFAQAELQLQSFPTVLLFPSRTARPIKYPSEKRDVDSLLAFVNSLR

SEQ ID NO: 14923 - protein, 444 aa, Panicum virgatum
GRAAARIGAMRQQVAVAPAAAAARGQRARAVRPLRAAEQGRQPVSASAASAAPAAPVADEVAAPAAVDYEALARELEGASPLEVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPLRRALRGLRAWITGQRKDQSPGTRASIPVVQVDPSFEGLDGGAGSLIKWNPVANVDGKDIWTFLRTMDVPVNSLHAQGFVSIGCEPCTRPVLPGQHEREGRWWWEDAKAKECGLHKGNIDKDGQAAAPKPANGNGAAGAPDIFESPAVVSLTRAGIENLLRLEKRAEPWLVVLYAPWCPFCQAMEASYVELADKLAGAGVKVAKFRADGEQKPFAQAELQLQSFPTVLLFPTRTARPIKYPSEKRDVDSLLAFVNSLR

SEQ ID NO: 14924 - protein, 464 aa, Panicum virgatum
RNSSALGARVCNCSENSSLSFGRAAARIGAVRQHVAVAPAARGQRARAVRPLRAVEQGRQPVTASAASAAPAAPVADEVAAPAAVDYEALARELEGASPLEVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPLRRALRGLRAWITGQRKDQSPGTRASIPVVQVDPSFEGLDGGAGSLIKWNPVANVDGKDIWTFLRTMDVPVNSLHAQGFVSIGCEPCTRPVLPGQHEREGRWWWEDAKAKECGLHKGNIEKDGQAAAPKPANGNGNGAAGAPDIFESPAVVSLTRAGIENLLRLENRAEPWLVVLYAPWCPFCQAMEASYVELAEKLAGAGVKVAKFRADGEQKPFAQAELQLQSFPTVLLFPTRTARPIKYPSEKRDVDSLLAFVNSLR

SEQ ID NO: 14925 - protein, 463 aa, Brachypodium distachyon
MASATASISSHAIALRDLKAARIGAVRQQVAAAPAAPAVRSQRARAVRPLCAAEPARKPLSASAAAAPVAPVLVEEEASAVPAAVDYEALAQELQGASPLEIMDRALSMFGSEIAIAFSGAEDVALIEYAKLTGRPFRVFSLDTGRLNPETYQLFDKVEKHYGIHIEYMFPEAAEVQELVRNKGLFSFYEDGHQECCRVRKVRPLRRALKGLKAWITGQRKDQSPGTRASIPVVQVDPSFEGLDGGAGSLIKWNPVANVEGKDIWTFLRTMDVPVNTLHAQGYVSIGCEPCTRPVLPGQHEREGRWWWEDATAKECGLHKGNIEKEGQAPKVGVNGNGSAEASAPDIFQSQAVVSLTRPGIENLLKLENRTEPWLTVLYAPWCPYCQAMEASYLELAEKLSGSGVKVAKFRADGEQKPFAQAELQLQSFPTILLFPSRTARPIKYPSEKRDVESLLAFVNSLR

SEQ ID NO: 14926 - protein, 475 aa, Oryza sativa
MASATASISSHSVALRDLKAARIGAVKQQVAAAPAAGTAAARAQRARAVRPLRAAEPARQPVSASAAAAPAAAPVAEDAAAAAVDAPAPAVDYEALAQELQGASPLEIMDRALAMFGSDIAIAFSGAEDVALIEYAKLTGRPFRVFSLDTGRLNPETYQLFDKVEKHYGIRIEYMFPDAGEVQALVRAKGLFSFYEDGHQECCRARKVRPLRRALRGLRAWITGQRKDQSPGTRAAIPVVQVDPSFEGLAGGAGSLVKWNPVANVDGKDVWTFLRAMDVPVNALHAQGYVSIGCEPCTRPVLPGQHEREGRWWWEDAKAKECGLHKGNIDDQGGAAAAAAHKAGGANGNGSAGAPDIFESSGVVSLTRAGVENLLRLESRAEPWLVVLYAPWCPFCQAMEASYLELAERLGGAGGGVKVGKFRADGEQKAFAQQELQLQSFPTILLFPSRTARPIKYPSEKRDVDSLLAFVNSLR

SEQ ID NO: 14927 - protein, 413 aa, Panicum virgatum
MEAFLAGFFRAPPRCGPAARAAPPIPGLPLFHGRRRRRPSSSVVCMAEPYLIAKLDSAEKAWKEMSVRLADPDIVSDPSEYQKLAQSVAELDQVVTTYRQFKDCEKQIEETKALEKENEDDPDMGEMIASELEALSNQLAELEEKLKLLLLPSDPLDSRNILLEVRAGAGGDEAGIWAGDLVRMYQKYCERNNWKFKPVSCSEAEMGGYKTYVMEVKGKQVYSKLKFESGVHRVQRVPQTETMGRVHTSTATVAIMPEADEVDVVIDPKDIELKTARSGGAGGQNVNKVETAVDLIHKPTGIRIFCTEERSQLQNRERAFQLLRAKLYEIKLREQQESIRNQRKLQVGTGARSEKIRTYNYKDNRVTDHRLKMNFELTSFLLGDIESAVQSCATMEQQELLEEMAASVGVAKV

SEQ ID NO: 14928 - protein, 368 aa, Sorghum bicolor
MAEPYLIAKLDSAEKAWKEMSVRLADPDIVSDPSEYQKLAQSVSELDQVVTTYRQFKDCERQLEETKALEKENEDDPDMSEMIASELEALSNQLAELEEKLKLLLLPSDPLDSRNILLEVRAGAGGDEAGIWAGDLVRMYQKYCERNNWKFKPVSCSEADMGGYKTYVMEVKGKQVYSKLKFESGVHRVQRVPLTETMGRVHTSTATVAIMPEADEVDVVIDPKDIELKTARSGGAGGQNVNKVETAVDLIHKPTGIRIFCTEERSQLQNKERAFQLLRAKLYEIKLREQQESIRNQRKMQVGTGARSEKIRTYNYKDNRVTDHRLKMNYELTGFLLGDIESAVQSCATLEQQELLEEMASSVGAVNV

SEQ ID NO: 14929 - protein, 416 aa, Oryza sativa
MEAFLAGFRAPRPRVPAVSAAARSLPPNTSFFSGGRRRRRLLSSSVVCMAEPYLIAKLDSAEKAWKEMSVRLADPDIVSDPSEYQKLAQSVAELDQVVSTYRQFKDCEKQIEETKVLQKENEDDPDMAEMIDSEMESLSNQLEELEEKLKLLLLPNDPLDARNILLEVRAGAGGDEAGIWAGDLVRMYQKYCERNSWKFKPVSSSEAEKGGFKTYVMEVKGKQVYSKLKFESGVHRVQRVPQTETMGRVHTSTATVAIMPEADEVDVVIDPKDIELKTARSGGAGGQNVNKVETAVDLIHKPTGIRIFCTEERSQLQNRERAFQLLRAKLYEIKLREQQESIRNQRKLQVGTGARSEKIRTYNYKDNRVTDHRLKMNFELTGFLMGDIESAVQSCSSMEQKELLEEMATSVGAAKV

SEQ ID NO: 14930 - protein, 367 aa, Brachypodium distachyon
MAEPHLISKLESTEKAWKEMSARLGDPDIVSDPSEYQKLAQSVADLGEVVSAYRQFKECERQIEETKALQKENGDDPDMAEMIASELESLSNQLAELEEKLTVLLLPSDPLNSRNILLEVRAGTGGDEAGIWAGDLVRMYQKYCELNNWKFKPVSCSEAEKGGYKTYVMEVKGKQVYSKLKFESGVHRVQRVPQTETMGRVHTSTATVAIMPEADEVDVVIDPKDIELKTARSGGAGGQNVNKVETAIDLIHKPTGIRIFCTEERSQLQNKERAFQLLRAKLYEIKLREQQESIRTQRLLQVGTGARSEKIRTYNYKDNRVTDHRLKMNFVLSSFLIGDIESAVQSCAAMEQKELLEEMATSSAVKA

SEQ ID NO: 14931 - protein, 368 aa, Zea mays
MAEPYLIAKLDSAEKAWKEMSVRLADPDIVSDPSEYQKIAQSVSELDQVVTTYRQFKDCERQLEATKALEKENEGDPDMLEMIASELEALSNQLAELEEKMKFLLLPSDPLDSRNILLEVRAGAGGDEAGIWAGDLVRMYQRYCERNNWKFKPVSCSEAEMGGYKTYVMEVKGKQVYSKLKFESGVHRVQRVPLTEAMGRVHTSTATVAIMPEADEVDVVIDPKDIELKTARSGGAGGQNVNKVETAVDLIHKPTGIRIFCTEERSQLQNRERAFQLLRAKLYEIKLREQQESLRNQRKLQVGTGARSEKIRTYNYKDNRVTDHRLKMNFELTSFLLGDIESAIQSCATMEQQELLEEMASSVGAVNV

SEQ ID NO: 14932 - protein, 368 aa, Setaria italica
MAEPYLIAKLDSAEKAWKEMSVRLADPDIVSDPSEYQKLAQSVAELDQVVTTYRQFKDCERNLEETKALEKENEEDPDMAEMIASELEALSNQLAELEEKLKLLLIPSDPLDARNILLEVRAGAGGDEAGIWAGDLVRMYQRYCERNNWKFKPVSCSEAEMGGYKTYVMEVKGKQVYSKLKFESGVHRVQRVPQTETMGRVHTSTATVAIMPEADEVDVVIDPKDIELKTARSGGAGGQNVNKVETAVDLIHKPTGIRIFCTEERSQLQNRERAFQLLRAKLYEIKLREQQESIRNQRKLQVGTGARSEKIRTYNYKDNRVTDHRLKMNFELTSFLLGDIESAVQSCATLEQQELLEEMASSVGVAKV

SEQ ID NO: 14933 - protein, 367 aa, Lolium multiflorum
MAEPHLISKLESTEKAWKEMSVRLGDPDIVSDPSEYQKLAQSVADLEEVVTAYRQFKECERQIEETKALQKENGDDPDMAEMIASELESLSNELAELEERLTVLLLPSDPLNSRNILLEVRAGTGGDEAGIWAGDLVRLYQKYCELNNWKFKPVSCSEAEKGGYKTYVMEVKGKQVYSKLKFESGVHRVQRVPQTETMGRVHTSTATVAIMPEADEVDVVIDPKDIELKAARSGGAGGQNVNKVETAIDLIHKPTGIRIFCTEERSQLQNKARAFQLLRAKLYEIKLREQQESLRTQRLLQVGTGARSEKIRTYNYKDNRVTDHRLKMNFVLSSFLLGDIEAAVQSCAALEQKELLEELATSSAVKA

SEQ ID NO: 14934 - protein, 93 aa, Setaria italica
MDKSMLGDLDGLPEEDKMRMAAMIDQLQIRDSLRMYNSLVERCFTDCVDTFRRKTLDKQEESCVRRCAEKFLKHSMRVGMRFAELNQGVATPD

SEQ ID NO: 14935 - protein, 93 aa, Zea mays
MDKSMLGDLDGLPEEDKMRMAAMIDQLQIRDSLRMYNSLVERCFTDCVDTFRRKNLDKQEESCVRRCAEKFLKHSMRVGMRFAELNQGVATPD

SEQ ID NO: 14936 - protein, 93 aa, Oryza sativa
MDKSMLGDLDGLPEEDKMRMAAMVDQLQIRDSLRMYNSLVERCFTDCVDTFRRKTLDKQEESCVRRCAEKFLKHSMRVGMRFAELNQGVATPD

SEQ ID NO: 14937 - protein, 93 aa, Sorghum bicolor
MDKSMLGDLDGLPEEDKMRMAAMVEQLQIRDSLRMYNSLVERCFTDCVDTFRRKTLDKQEESCVRRCAEKFLKHSMRVGMRFAELNQGVATPD

SEQ ID NO: 14938 - protein, 93 aa, Panicum virgatum
MDKSMLGDLDGLPEEDKMRMAAMIEQLQIRDSLRMYNNLVERCFTDCVDTFRRKTLDKQEESCVRRCAEKFLKHSMRVGMRFAELNQGVATPD

SEQ ID NO: 14939 - protein, 93 aa, Setaria italica
MDKSLLGDLDGLPEEDKMRMAAMVDQLQIRDSLRMYNSLVERCFTDCVDTFRRKTLDKQEESCVHRCAEKFLKHSMRVGMRFAELNQGVATPD

SEQ ID NO: 14940 - protein, 93 aa, Lolium multiflorum
MDKSMLGDLDNLPEEDKMRMAVMVDQLQVRDSLRMYNNLVERCFTDCVETFRRKTLDKQEESCVRRCAEKFLKHSMRVGMRFAELNQGVATPD

SEQ ID NO: 14941 - protein, 95 aa, Brachypodium distachyon
MDKGMGMLGDLDNLPDEDKMRMASMVDQLQIRDSLRMYNSLVERCFTDCVDTFRRKTLDKQEESCVRRCAEKFLKHSMRVGMRFAELNQGVATPD

SEQ ID NO: 14942 - protein, 87 aa, Cenchrus ciliaris
GDLDGLPEEDKMRMAAMIDQLQIRDSLRMYNSLVERCFTDCVDTFRRKTLDKQEESCVRRCAEKFLKHSMRVGMRFAELNQGVATPD

SEQ ID NO: 14943 - protein, 93 aa, Echinacea purpurea
MDKSMLGDLDALPEEDKLRMSSMIDQLQIRDSLRMYNTLVERCFTDCVDTFRRKTLDKQEETCVRRCAEKFLKHSMRVGMRFAELNQGAATPD

SEQ ID NO: 14944 - protein, 93 aa, Triphysaria pusilla
MDKSMLGDLDALPEEDKQRMSAMIDQLQIRDSLRMYNSLVERCFTDCVDTFRRKTLDKQEETCVRRCAEKFLKHSMRVGMRFAELNQGAPTPD

SEQ ID NO: 14945 - protein, 93 aa, Olea europaea
MDKSMLGDLDSLPEEDKLRMSSMIDQLQIRDSLRMYNSLVERCFTDCVDTFRRKSLDKQEETCVRRCAEKFLKHSMRVGMRFAELNQGAATPD

SEQ ID NO: 14946 - protein, 93 aa, Ocimum basilicum
MDKSMLGDLDALPEEDKLRMTAMIDQLQIRDSLRMYNTLVERCFTNCVDTFRRKTLDKQEETCVRRCAEKFLKHSMRVGMRFAELNQGAATPD

SEQ ID NO: 14947 - protein, 87 aa, Cenchrus ciliaris
GDLDGLPEEDKMRMAAMIDQLQIRDSLRMYNSLVEKCFTDCVDTFRRKTLDKQEESCVRRCAEKFLKHSMRVGMRFAELNQGVATPD

SEQ ID NO: 14948 - protein, 93 aa, Olea europaea
MDKSMLGDLDSLPEDDKLRMSSMIDQLQIRDSLRMYNSLVERCFTDCVDTFRRKSLDKQEETCVRRCAEKFLKHSMRVGMRFAELNQGAATPD

SEQ ID NO: 14949 - protein, 87 aa, Cenchrus ciliaris
GDLDGLPEEDKMRMAAMIDQLQIRDSLRMYNSLVEKCFTDCVDTFRRKTLDKQEESCVRCCAEKFLKHSMRVGMRFAELNQGVATPD

SEQ ID NO: 14950 - protein, 93 aa, Mimulus guttatus
MDKSMLGDLDALPEEDKLRMSAMIDQLQVRDSLRMYNSLVERCFTDCVDSFRRKSLDKQEETCVRRCAEKFLKHSMRVGMRFAELNQGAATPD

SEQ ID NO: 14951 - protein, 93 aa, Nicotiana benthamiana
MDKSMIGDLDSLPEEDKLKMAAMIDQLQIRDSLRMYNSLVERCFTDCVDTFKRKTLDKQEETCVRRCAEKFLKHSMRVGMRFAELNQGAPTPD

SEQ ID NO: 14952 - protein, 93 aa, Vitis vinifera
MDKSMLGDLDSLPEEDKLRMSVMIDQLQIRDSLRMYNSLVERCFSDCVESFRRKSLDKQEETCVRRCAEKFLKHSMRVGMRFAELNQGTATPD

SEQ ID NO: 14953 - protein, 93 aa, Chenopodium quinoa
MDKNMLGDLDNLPEEDKMKMAAMIDQLQIRDSLRMYNSLVERCFTDCVDSFRRKTLDKQEETCVRRCAEKFLKHSMRVGLRFAELNQGAPTQD

SEQ ID NO: 14954 - protein, 93 aa, Mimulus guttatus
MDKSMLGDLDSLPEEDKLRMSAMIDQLQVRDSLRMYNSLVERCFTDCVESFRRKTLDKQEETCVRRCAEKFLKHSMRVGMRFAELNQGAPTPD

SEQ ID NO: 14955 - protein, 94 aa, Panax ginseng
MDKNMLGDLDSLPEEDKVRMASMIDQLQIRDSLRMYNSLVERCFTDCVDTFRRKSLDKQEETCVRRCAEKFLKHSMRVGMRFAELNQGAPAQDS

SEQ ID NO: 14956 - protein, 93 aa, Chenopodium quinoa
MDKNMLGDLDNLPEEDKMKMAAMIDQLQIRDSLRMYNSLVERCFTDCVDSFRRKTLDKHEETCVRRCAEKFLKHSMRVGLRFAELNQGAPTQD

SEQ ID NO: 14957 - protein, 93 aa, Vitis vinifera
MDKSMLGDLDSLPEEAKLRMSAMIDQLQIRDSLRMYNSLVERCFTDCVDSFPRKSLDKQEETCVRRCAEKFLKHSMRVGMRFAELNQGTATQD

SEQ ID NO: 14958 - protein, 93 aa, Prunus mume
MDKSMIGDLDSLPEEDKLRMATMIDQLQIRDSLRMYNSLVERCFTDCVDTFKHKSLQKQEETCVRRCAEKFLKHSMRVGMRFAELNQGAATQD

SEQ ID NO: 14959 - protein, 93 aa, Zostera marina
MDKSLLGDLDSLPEGDKIRMSQMIDQLQIRDSLRMYNSLVERCFTDCVDTFRRKTLDKQEDTCVRRCAEKFLKHSMRVGLRFAELNQGAPTPD

SEQ ID NO: 14960 - protein, 94 aa, Panax ginseng
MDKNMLGDLDSLPEADKLRMASMIDQLQIRDSLRMYNSLVERCFTDCVDTFRRKSLDKQEETCVRRCAEKFLKYSMRVGMRFAELNQGAPTQDS

SEQ ID NO: 14961 - protein, 94 aa, Panax ginseng
MDKNMLGDLDSLPEADKLRMASMIDQLQIRDSLRMYNSLVERCFTDCVDNFRRKSLDKQEETCVRRCAEKFLKHSMRVGMRFAELNQGAPTQDS

SEQ ID NO: 14962 - protein, 94 aa, Panax ginseng
MDKNMLGDLDSLPEEDKVRMASMIDQLQIRDSLRMYNSLVERCFADCVDSFRRKSLDKQEEACVRRCAEKFLKHSMRVGMRFAELNQGAPTQDS

SEQ ID NO: 14963 - protein, 93 aa, Nicotiana benthamiana
MDKSMLGDLDNLPEADKLKMASMIDQLQIRDSLRMYNSLVERCFTGCVDTFKRKTLDKQEETCITRCAEKFLKHSMRVGMRFAELNQGAATQD

SEQ ID NO: 14964 - protein, 93 aa, Nicotiana benthamiana
MDKSMIGDLDSLPEAEKLKIAAMIDQLQIRDSLRMYNSLVERCFTDCVDTFKRKTLDKQEETCVRRCAEKFLKHSMRVGMRFAELNQGAPTPD

SEQ ID NO: 14965 - protein, 94 aa, Panax ginseng
MDKNMLGDLDSLPEADKLRMASMIDQLQIRDSLRMYNSLVERCFTDCVDNFRRKSLDKQEETCVRRCAEKFLKHSMRVGMRFAELNQGAPAQDS

SEQ ID NO: 14966 - protein, 94 aa, Prunus mume
MDKGMLAADLEGLPEEDKHRMATLIDQLQIRDSLRMYNSLVERCFTDCVDTFQRKALTKQEDSCVRRCAEKFLKHSMRVGMRFAELNQGAATQD

SEQ ID NO: 14967 - protein, 340 aa, Centaurea maculosa
MGCSFSGLNALYDSAASDVWINETRYKIVRQLGEGGFAFVFLVKEVINESSDGGLSKKFKDPSHISDDGTYAMKKVLVQNNEQLQFVKEEIRISSLFNHPNLLPLLDHAIISVKGTPEQTWTHEAYLLFPAHLDGTLLDHAKTMKAKKESFSTSDVLEIFRQLCAGLKHMHNLETPYAHNDVKPGNVLLTHRKGQPPLAVLMDFGSARPARRQIRSRSEALQLQEWAAEHVSAPFRSPELWDCPSQADIDERTDVWSLGCTLYAIMYGVSPFEYALGESGGSLQLAIVNAQIKWPTTPKPSYPEALHQFISWMVQPQATVRPRIDDILIHVDKLITKFSN

SEQ ID NO: 14968 - protein, 93 aa, Festuca arundinacea
MDKSMLGDMENLPQEDQMRMAVMVDQLQVRDSLRMYNNLVERCFTDCVETFRRKTLDKQEESCVKRCAEKFLKHSMRVGMRFAELNQGAPTPD

SEQ ID NO: 14969 - protein, 93 aa, Panax ginseng
MDKNMLGDLSSLPQEDQAKMASMIDQLQIRDSLRMYNSLVETCFTDCVDMFRRKTLDKQEETCVRRCAEKFLKHSMRVGMRFAELNQGAATQD

SEQ ID NO: 14970 - protein, 93 aa, Solanum lycopersicum
MDKSMIGDLDSLPEADKIRMAAMIEQLQVRDSLRMYNSLVERCFTDCVDSFKRKTLDKQEETCVRRCAEKFLKHSMRVGLRFAELNQGAPTPD

SEQ ID NO: 14971 - protein, 94 aa, Echinacea purpurea
MDKSMLGDLGTLPPEDQARMSTMIDQLQIRDSLRMYNTLVERCFTDCVDSFRRKTLDKQEETCVKRCAEKFLKHSMRVGMRFAELNQGAATQDE

SEQ ID NO: 14972 - protein, 93 aa, Centaurea maculosa
MDKNMLGDLGNLPAEDQARMATMIDQLQVRDSLRMYNTLVERCFTDCVDTFRRKTLDKQEETCVRRCAEKFLKHSMRVGLRFAELNQNAATSD

SEQ ID NO: 14973 - protein, 93 aa, Lupinus angustifolius
MDKSMLGDLDSLPEADKQRMSTMIDQLQIRDSLRMYNSLVERCFTDCVDTFKHKSLTKQEETCIRRCAEKFLKHSMRVGLRFAELNQGAATQD

SEQ ID NO: 14974 - protein, 93 aa, Glycine max
MDKSMLADLDSLPEADKQRMTVMIDQLQIRDSLRMYNSLVERCFSDCVDTFKHKSLQKQEETCVRRCAEKFLKHSMRVGMRFAELNQGAATQD

SEQ ID NO: 14975 - protein, 93 aa, Glycine max
MDKSMLADLDSLPEADKQRMTVMIDQLQIRDSLRMYNSLVERCFNDCVDTFKHKSLQKQEETCVRRCAEKFLKHSMRVGMRFAELNQGAATQD

SEQ ID NO: 14976 - protein, 93 aa, Lupinus angustifolius
MDKSMLGDLDSLPEADKQRMSTMIEQLQMRDSLRMYNSLVERCFTDCVDTFKHKSLTKQEETCIRRCAEKFLKHSMRVGMRFAELNQGAATQD

SEQ ID NO: 14977 - protein, 93 aa, Cicer arietinum
MDKSMIADMESLPEADKLRMAGMIEQLQIRDSLRMYNSLVEKCFNDCVDTFKHKSLQKQEETCVRRCAEKFLKHSMRVGMRFAELNQGAATQD

SEQ ID NO: 14978 - protein, 80 aa, Ocimum basilicum
EEDKLRMSAMIDQLQVRDSLRMYNSLVERCFTDCVDTFRRKTLDKQEETCVRRCAEKFLKHSMRVGMRFAELNQGVATPD

SEQ ID NO: 14979 - protein, 79 aa, Panicum virgatum
MDKSMLGDLDGLPEEDKMRMASMIEQLQIRDSLRMYNSLVERCFTDCVDTFRRKTLDKQEESCVRRCAEKFLKHSMRLA

SEQ ID NO: 14980 - protein, 16 aa, Zea mays
MEKVWESGRRMSRSIG

SEQ ID NO: 14981 - protein, 16 aa, Sorghum bicolor
MEKVWESGRRMSRSIS

SEQ ID NO: 14982 - protein, 16 aa, Panicum virgatum
MEKVWESGRRASRSIS

SEQ ID NO: 14983 - protein, 16 aa, Setaria italica
MEKVWESGRRMSRSIG

SEQ ID NO: 14984 - protein, 16 aa, Oryza sativa
MEKVWESGRRMSRSIG

SEQ ID NO: 14985 - protein, 16 aa, Oryza sativa
MEKVWESGRRMSRSIG

SEQ ID NO: 14986 - protein, 16 aa, Brachypodium distachyon
MEKVWDSGRRMSRSIG

SEQ ID NO: 14987 - protein, 16 aa, Panicum virgatum
KHLCRRVGIELPTVEV

SEQ ID NO: 14988 - protein, 16 aa, Triticum aestivum
MDKFVTDKNGVSKRLG

SEQ ID NO: 14989 - protein, 394 aa, Gossypium raimondii
MASSPLFSMSTMKRDSFVMKTITSNKEFKFNVSNSFDKLPVTSPTLLLTGENSLKWGQNESLLRNRMQCCAVEVKNMPGYPMGKKFELDDVIEAQQFDRETLNAIFEVAKEMENIKKNSPGSQILKGYLMATLFYEPSTRTRLSFESAMKRLGGEVLTTENAREFSSAAKGETLEDTIRTVEGYSDIIVMRHFESGAAKRAAATAGIPIINAGDGPGQHPTQALLDVYTIEREIGKLDGIRVGLVGDLANGRTVRSLAYLLAEYQDVKIYFVSPDVVKMKDDIKKYLTRRGVEWEESGDLMEVASKCDVVYQTRIQRERFGERINLYEEARGKYIVDENVLKVMQSHAVVMHPLPRLDEITVDVDADPRAAYFRQAKNGLYIRMALLKLLLVGW

SEQ ID NO: 14990 - protein, 394 aa, Gossypium raimondii
MASSPLFSMSTMKRDSFVMKTITSNKEFKFNVSNPFDKLPVTSPTLLLTGENSLKWGQNESLLRNRMQCCAVEVKNMPRYTMGKKFELDDVIEAQQFDRETLNAIFEVAKEMENIKKNSPGSQILKGYLMATLFYEPSTRTRLSFESAMKRLGGEVLTTENAREFSSAAKGETLEDTIRTVEGYSDIIVMRHFESGAAKRAAATAGIPIINAGDGPGQHPTQALLDVYTIEREIGKLDGIRVGLVGDLANGRTVRSLAYLLAKYQDVKIYFVSPDIVKMKDDIKDYLTSRGVEWEESGDLMEVASKCDVVYQTRIQRERFGERIDLYEEARGKYIVDENVLKVMQKHAVVMHPLPRLDEITVDVDADPRAAYFRQAKNGLYIRMALLKLLLVGW

SEQ ID NO: 14991 - protein, 394 aa, Gossypium hirsutum
MASSPLFSMSTMKRDSFVMKTITSNKEFKFNVSNPFDKLPVTSPTLLLTGENSLKWGQNESLLRNRMQCRAVEVKNMPRYTMGKKFELDDVIEAQQFDRETLNAIFEVAKEMENIEKNSPGSQILKGYLMATLFYEPSTRTRLSFESAMKRLGGEVLTTENAREFSSAAKGETLEDTIRTVEGYSDIIVMRHFESGAAKRAAATAGIPIINAGDGPGQHPTQALLDVYTIEREIGKLDGIRVGLVGDLANGRTVRSLAYLLAKYQDVKIYFVSPDIVKMKDDIKDYLTSRGVEWEESGDLMEVASKCDVVYQTRIQRERFGERIDLYEEARGKYIVDENVLKVMQKHAVVMHPLPRLDEITVNVDADPRAAYFRQAKNGLYIRMALLKLLLVGW

SEQ ID NO: 14992 - protein, 401 aa, Theobroma cacao
MASSSSFSTCTLNRGSFATKAINFNKVFKCNFSSLPNRLPVSAKLSADFTCSRLLTSEKSLKLDQSQRLSRNGMQCCALEVEDVPTFLVGKKFQLDDVIEAQQFDRDILNAIFEVAREMENIEKKSPGSQILKGYLMATLFYEPSTRTRLSFESAMKRLGGEVLTTENAREFSSAAKGETLEDTIRTIEGYSDIIVMRHFESGAARRAAATAGIPIINAGDGPGQHPTQALLDVYTIEREIGKLDGIRVGLVGDLANGRTVRSLAYLLAKYQDVKIYFVSPDVVKMKDDIKDYLTSLGVEWEESADLMEVASKCDVVYQTRIQRERFGERIDLYEEARGKYIVDKEVLKVMQKHAVVMHPLPRLDEITVDVDADPRAAYFRQAKNGLYIRMALLKLLLVGW

SEQ ID NO: 14993 - protein, 413 aa, Theobroma cacao
MASSSSFSTCTLNRGSFATKAINFNKVFKCNFSSLPNRLPVSAKLSADFTCSRLLTSEKSLKLDQSQRLSRNGMQCCALEVEDVPTFLVGKKFQLDDVIEAQQFDRDILNAIFEVAREMENIEKKSPGSQILKGYLMATLFYEPSTRTRLSFESAMKRLGGEVLTTENAREFSSAAKGETLEGNFLYLFVMILRNTIRTIEGYSDIIVMRHFESGAARRAAATAGIPIINAGDGPGQHPTQALLDVYTIEREIGKLDGIRVGLVGDLANGRTVRSLAYLLAKYQDVNIYFVSPDVVKMKDDIKDYLTSLGVEWEESADLMEVASKCDVVYQTRIQRERFGERIDLYEEARGKYIVDKEVLKVMQKHAVVMHPLPRLDEITVDVDADPRAAYFRQAKNGLYIRMALLKLLLVGW

SEQ ID NO: 14994 - protein, 159 aa, Arabidopsis lyrata
MSSKKIVLKSSDGESFEVEEAVALESQTIAHMVEDDCVDNGVPLPNVTSKILAKVIEYCKKHVEVAAAKSEAVDGATSDEDLKAWDTEFMKIDQATLFELILAANYLNIKNLLDLTCQTVADMIKGKTPEEIRTTFNIKNDFTPEEEEEVRRENQWAFE

SEQ ID NO: 14995 - protein, 160 aa, Brassica juncea
MSTKKIVLKSSDGESFEVDEAVALESQTIAHMVEDDCVDNGIPLPNVTSKILAKVIEYCKKHVDAAASKTEAVDGGASSDDDLKAWDAEFMKIDQATLFELILAANYLNIKNLLDLTCQTVADMIKGKTPEEIRTTFNIKNDFTPEEEEEVRRENQWAFE

SEQ ID NO: 14996 - protein, 160 aa, Raphanus sativus
MSTKKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIKGKTPEEIRTTFNIKNDFTPEEEEEVRRENQWAFE

SEQ ID NO: 14997 - protein, 160 aa, Raphanus sativus
MSTKKIVLKSSDGESFEVDEAVALESQTIAHMVEDDCVDNGVPLPNVTSKILAKVIEYCKKHVDAAASKTEAVDGGGSSDDDLKAWDAEFMKIDQATLFELILAANYLNIKNLLDLTCQTVADMIKGKTPEEIRTTFNIKNDFTPEEEEEVRRENQWAFE

SEQ ID NO: 14998 - protein, 159 aa, Eutrema parvulum
MSLKKIVLKSSDGESFEVDEAVALESQTIAHMVEDDCVDNGVPLPNVTSKILAKVIEYCKKHVDAAASKSEAVDGGSSDDDLKAWDAEFMKIDQATLFELILAANYLNIKNLLDLTCQTVADMIKGKTPEEIRTTFNIKNDFTPEEEEEVRRENQWAFE

SEQ ID NO: 14999 - protein, 160 aa, Unknown
  Sequence found in Organisms: Brassica napus, Brassica juncea, Brassica rapa
MSTKKIVLKSSDGESFEVDEAVALESQTIAHMVEDDCVDNGIPLPNVTSKILAKVIEYCKKHVDAAASKTEAVDGGASSDDDLKAWDAEFMKIDQATLFELILAANYLNIKNLLDLTCQTVADMIKGKTPEEIRTTFNIKNDFTAEEEEEVRRENQWAFE

SEQ ID NO: 15000 - protein, 160 aa, Unknown
  Sequence found in Organisms: Brassica napus, Brassica juncea, Brassica nigra, Brassica oleracea, Brassica rapa
MSTKKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIKGKTPEEIRTTFNIKNDFSPEEEEEVRRENQWAFE

SEQ ID NO: 15001 - protein, 160 aa, Brassica juncea
MSTRKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIKGKTPEEIRTTFNIKNDFTPEEEEEVRRENQWAFE

SEQ ID NO: 15002 - protein, 159 aa, Unknown
  Sequence found in Organisms: Eutrema halophilum, Eutrema parvulum
MSSKKIVLKSSDGESFEVDEAVALESQTIAHMVEDDCVDNGVPLPNVTSKILAKVIEYCKKHVDSAASKSEAVDGASSDEDLKAWDTEFMKIDQATLFELILAANYLNIKNLLDLTCQTVADMIKGKTPEEIRTTFNIKNDFTPEEEEEVRRENQWAFE

SEQ ID NO: 15003 - protein, 160 aa, Brassica napus
MSTKKIVLKSSDGESFEVDEAVALESQTIAHMVEDDCVDNGIPLPNVTSKILAKVIEYCKKHVDAAASKTDAVDGGASSDDDLKAWDAEFMKIDQATLFELILAANYLNIKNLLDLTCQTVADMIKGKTPEEIRTTFNIKNDFTAEEEEEVRRENQWAFE

SEQ ID NO: 15004 - protein, 160 aa, Brassica napus
MSTKKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIKGKTPEEIRTTFNIKNDFSPEEEEEVRRENQWALE

SEQ ID NO: 15005 - protein, 160 aa, Raphanus sativus
MSTKKIVLKSSDGESFEVDEAVALESQTIAHMVEDDCVDNGIPLPNVTSKILAKVIEYCKKHVDAAASKTEAVDGGASSDDDLKAWDGEFMKIDQATLFELILAANYLNIKNLLDLTCQTVADMIKGKTPEEIRQTFNIKNDFTPEEEEEVRRENQWAFE

SEQ ID NO: 15006 - protein, 161 aa, Brassica juncea
MSTKKIVLKSSDGESFEVDEAVARESQTLAHMVEDDCIENGIPLPNVTSKILAKVIEYCKKHVDAAAAKTEGAVDGAASSDDDLKAWDTEFMKIDQATLFELILAANYLNIKNLLDLTCQTVADMIKGKTPEEIRTTFNIKNDFSPEEEEEVRRENQWAFE

SEQ ID NO: 15007 - protein, 160 aa, Raphanus sativus
MSTKKIVLKSSDGESFEVDEAVARESQTLAHMVEDDCIENGIPLPNVTSKILAKVIEYCKKHVDAAAAKTEAVDGGASSDDDLKAWDVEFMKIDQATLFELILAANYLNIKNLLDLTCQTVADMIKGKTPEEIRATFNIKNDFTPEEEEEVRRENQWAFE

SEQ ID NO: 15008 - protein, 161 aa, Unknown
  Sequence found in Organisms: Brassica napus, Brassica oleracea
MSTKKIVLKSSDNESFEVDEAVARESQTLAHMVEDDCTDNGIPLPNVTGKILAKVIEYCKKHVDAAAAKTEAAADGGASSDDDLKAWDAEFMKIDQATLFELILAANYLNIKNLLDLTCQTVADMIKGKTPDEIRTTFNIKNDFSPEEEEEVRRENQWAFE

SEQ ID NO: 15009 - protein, 542 aa, Arabidopsis lyrata
MEGLKPSAANSSPLTPLGFLERAATVYGDFTSIVYGNSTVYTWQETNLRCLRVASALSSIGIGRSDVVSVLSANTPEMYELQFAVPMCGAILNNLNTRLDAQTVSVLLRHCESKLLFVDVFYSDLVVEAIATLLNPPILVLIADQEEGAAVVTERSKFCYLYSDLVKRGNPDFKWIRPESEWDPIVVNYTSGTTSSPKGVVHCHRGIFVMALDSLTDWAVPKNPVYLWTLPIFHANGWTYPWGIAAVGGTNVCVRKLHAPLLYRLIRDHGVTHMCGAPILLQILSASQESEQPLKNPVKFLTAGSAPPATVLLRAESLGFIVSHGYGLTETAGVIVSCAWNPKWNRLPASDQARLKSRQGVRTVGFSEIDVVDPESGRRVERDGATFGEIVMRGSSIMLGYLKDPIGTQKSFKNGWFFTGDVGVIHGDGYLEIKDRSKDVIISGGENVSSVEVEAVLYTNPAVNEAAVVARPDEFWGETPCAFVSLKPGLTRKPTDKEIIEYCKKKMPRYMVPKTVSFLEELPKSSTGKITKLLLKEIAKKM

SEQ ID NO: 15010 - protein, 161 aa, Unknown
  Sequence found in Organisms: Brassica napus, Brassica rapa
MSTKKIVLKSSDAESFEVDEAVARESQTLAHMVEDDCTDNGIPLPNVTGKILAKVIEYCKKHVDAAAAKTEATADGGAPSDEDLKAWDAEFMNIDQATLFELILAANYLNIKNLLDLTCQTVADMIKGKTPDEIRTTFNIKNDFSPEEEEEVRRENQWAFE

SEQ ID NO: 15011 - protein, 160 aa, Brassica juncea
STKKIVLKSSDDESFEVDEAVARESQTLAHMVEDDCTDNGIPLPNVTGKILAKVIEYCKKHVDAAAAKTEATADGGAPSDEDLKAWDAEFMNIDQATLFELILAANYLNIKNLLDLTCQTVADMIKGKTPDEIRTTFNIKNDFSPEEEEEVRRENQWAFE

SEQ ID NO: 15012 - protein, 159 aa, Euphorbia peplus
MSSKKIVLKSSDGESFEVEEAVAVESQTIKHMIEDDCADNGIPLPNVTSKILAKVIEYCKKHVESGAAKAEDRSSASSDDDLKTWDADFVKVDQATLFDLILAANYLNIKGLLDLTCQTVADMIKGKTPEEIRKTFNIKNDFTAEEEEEVRRENQWAFE

SEQ ID NO: 15013 - protein, 92 aa, Brassica napus
MSTKKIVLKSSDNESFEVDEAVARESQTLAHMIEDDCTDNGIPLPNVTGKILAKVIEYCKKHVDAAACQDRGRPPMVALPPTMTSRLGMPSS

SEQ ID NO: 15014 - protein, 156 aa, Cyamopsis tetragonoloba
MSTTKKITLKSSDGEAFEVEEVVALESQTIKHMIEDDCADSGIPLPNVNSKILAKVIEYCKKHVEAAASEAEKASEDDLKAWDADFVKVDQATLFDLILAANYLNIKSLLDLTCQTVADMIKGKTPEEIRKTFNIKNDFTPEEEEEVRRENQWAFE

SEQ ID NO: 15015 - protein, 156 aa, Ipomoea batatas
MSSSKMIVLKSSDGETFEVEEAVALESQTIKHMIEDDCADTVIPLPNVTSKILAKVIEYCKRHVEAAAKSEDKPGDDDLKTFDADFVKVDQATLFDLILAANYLNIKSLLDLTCQTVADMIKGKTPEEIRKTFNIKNDFTPEEEEEVRRENAWAFE

SEQ ID NO: 15016 - protein, 156 aa, Prunus persica
MSSSSKKITLKSSDGESFEVEEAVALESQTIKHMIEDDCADNGIPLPNVTSKILAKVIEYCKKHVDAAKPDEKISEDDLKAWDQDFVKVDQATLFDLILAANYLNIKLLLDLTCQTVADMIKGKTPEEIRKTFNIKNDFTPEEEEEVRRENQWAFE

SEQ ID NO: 15017 - protein, 155 aa, Glycine max
MSSAKKITLKSSDGEAFEVEEAVALESQTIKHMIEDDCADSGIPLPNVTSKILAKVIEYCKKHVEAANPEDKPSEDDLKAWDAEFVKVDQATLFDLILAANYLNIKSLLDLTCQTVADMIKGKTPEEIRKTFNIKNDFTPEEEEEVRRENQWAFE

SEQ ID NO: 15018 - protein, 156 aa, Ipomoea nil
MSSSKMIVLKSSDGETFEVEEAVALESQTIKHMIEDDCADTVIPLPNVTSKILAKVIEYCKRHVEAASKTEEKPGEDDLKTFDADFVKVDQATLFDLILAANYLNIKSLLDLTCQTVADMIKGKTPEEIRKTFNIKNDFTPEEEEEVRRENAWAFE

SEQ ID NO: 15019 - protein, 155 aa, Lotus japonicus
MSSAKKITLKSSDGEAFEVDEAVALESQTIKHMVEDDCADSGIPLPNVTSKILAKVIEYCKKHVEAANPDEKPTEDELKAWDADFVKVDQATLFDLILAANYLNIKSLLDLTCQTVADMIKGKTPEEIRKTFNIKNDFTPEEEEEVRRENQWAFE

SEQ ID NO: 15020 - protein, 155 aa, Quercus alba
MSSSKKITLKSSDGEAFEVEEAVALESQTIKHMIEDDCADNGIPLPNVTSKILAKVIEYCKKHVEATCADERTSDEDLKAWDTEFVRVDQATLFDLILAANYLNIKSLLDLTCQTVADMIKGKTPEEIRKTFNIKNDFTPEEEEEVRRENQWAFE

SEQ ID NO: 15021 - protein, 155 aa, Glycine max
MSSAKKITLKSSDGEAFEVDEAVALESQTIKHMIEDDCADSGIPLPNVTSKILAKVIEYCKKHVEAANPEDKPSEDDLKAWDADFVKVDQATLFDLILAANYLNIKSLLDLTCQTVADMIKGKTPEEIRKTFNIKNDFTPEEEEEVRRENQWAFE

SEQ ID NO: 15022 - protein, 163 aa, Glycine max
MSSTKSFKCPLIFPTNFLFFLRGEVILNVKGLANFLGSLPLDHVGYSLACKVQQALDVQVVRNQDKIEERGLVDLDEIGVPGFEIVLGGFVFGIRGLDVLLAVLDHLRQDLARHVRQRDAAVGAVVLDHVLYRLRLQRHRLVHLESLAVRTLQCDLLRRRHDD

SEQ ID NO: 15023 - protein, 102 aa, Cicer arietinum
MSSTKKITLKSSDGEAFEVDEAVALESQTIKHMIEDDCADSGIPLPNVTSKILAKVIEYCKKHVEAASSDDKPTEDDLKAWDADFVKVDQATLFDLIRLQTT

SEQ ID NO: 15024 - protein, 156 aa, Malus domestica
MSSSSKKITLKSSDGESFEVEEAVALESQTIKHMIEDDCADNGIPLPNVTSKILAKVIEYCKRHVDAAKPDEKISEDDLKAWDQEFVKVDQATLFDLILAANYLNIKSLLDLTCQTVADMIKGKTPEEIRKTFNINNDFTPEEEEEVRRENQWAFE

SEQ ID NO: 15025 - protein, 156 aa, Malus domestica
MSSSSKKITLKSSDGESFEVEEAVALESQTIKHMIEDDCADNGIPLPNVTSKILAKVIEYCKKHVDAAKPDEKISEDDLKAWDQEFVKVDQATLFDLILAANYLNIKTLLDLTCQTVADMIKGKTPEEIRKTFNIKNDFTPEEEEEVRRENQWAFE

SEQ ID NO: 15026 - protein, 156 aa, Rosa hybrid cultivar
MSSSAKKITLKSSDGESFEVEEAVALESQTIKHMIEDDCADNGIPLPNVTSKILAKVIEYCKKHVDAAKPDEKVTEEELKIWDQDFVKVDQATLFDLILAANYLNIKNLLDLTCQTVADMIKGKTPEEIRKTFNIKNDFTPEEEEEVRRENQWAFE

SEQ ID NO: 15027 - protein, 156 aa, Fragaria vesca
MSSSAKKITLKSSDGESFEVEEAVALESQTIKHMIEDDCADNGIPLPNVTSKILAKVIEYCKKHVDAAKPDEKVTEEELKVWDQDFVKVDQATLFDLILAANYLNIKNLLDLTCQTVADMIKGKTPEEIRKTFNIKNDFTPEEEEEVRRENQWAFE

SEQ ID NO: 15028 - protein, 157 aa, Ricinus communis
MSAGKKITLKSSDGETFEVEELVALESQTIKHMIEDDCADSGIPLPNVTSKILSKVIEYCKKHVETPKSEDRPSSADDDLKAWDAEFVKVDQATLFDLILAANYLNIKSLLDLTCQTVADMIKGKTPEEIRKTFNIKNDFTPEEEEEVRRENQWAFE

SEQ ID NO: 15029 - protein, 155 aa, Glycyrrhiza uralensis
MSSTKKITLKSSDGEAFEVDEAVALESQTIKHMIEDDCADSGIPLPNVTSKILAKVIEYCKKHVEAANSDEKPSEDELKAWDADFVKVDQATLFDLILAANYLNIKSLLDLTCQTVADMIKGKTPEEIRKTFNIKNDFTPEEEEEVRRENQWAFE

SEQ ID NO: 15030 - protein, 156 aa, Unknown
  Sequence found in Organisms: Nicotiana benthamiana, Nicotiana tabacum
MSTSKMIVLKSSDGETFEVEEAVALESQTIKHMIEDDCADTSIPLPNVTSKILAKVIEYCKRHVDAVAKTDDKASEDDLKSFDADFVKVDQATLFDLILAANYLNIKSLLDLTCQTVADMIKGKTPEEIRKTFNIKNDFTPEEEEEVRRENAWAFE

SEQ ID NO: 15031 - protein, 156 aa, Unknown
  Sequence found in Organisms: Prunus persica, Prunus mume
MSSERKITLKSSDGETFEVDEAVALESQTIKHMVEDDCADNGIPLPNVTSKILAKVIEYCKKHVDAAKPDDRPSNDEDLKAWDTDFVKIDQATLFDLILAANYLNIKSLLDLTCQTVADMIKGKTPEEIRKTFNIKNDFTPEEEEEVRRENQWAFE

SEQ ID NO: 15032 - protein, 155 aa, Glycine max
MSSAKKITLKSSDGEAFEVDEAVALESQTIKHMIEDDCADSGIPLPNVTSKILAKVIEYCKKHVEAANPEDKPSEDDLKAWDADFVKVDQATLFDLILVANYLNIKSLLDLTCQTVADMIKGKTPEEIRKTFNIKNDFTPEEEEEVRRENQWAFE

SEQ ID NO: 15033 - protein, 156 aa, Panax ginseng
MSSTKITLKSSDGEVFEVDQAVALESQTIKHMIEDDCADNGIPLPNVTSKILSKVIEYCKKHVDAPAAEDRAVTADDDLKTFDADFVKVDQATLFDLILAANYLNIKSLLDLTCQTVADMIKGKTPEEIRKTFNIKNDFTPEEEEEVRRENQWAFE

SEQ ID NO: 15034 - protein, 157 aa, Liriodendron tulipifera
MASKKVTLKSSDGEEFVIDEAVALESQTIKHMIEDDCADNGIPLPNVTSKILSKVIEYCKKHVEAAAGKNPDDRASDDELKTWDADFVKVDQATLFDLILAANYLNIKSLLDLTCQTVADMIKGKTPEEIRRTFNIKNDFTPEEEEEVRRENQWAFE

SEQ ID NO: 15035 - protein, 154 aa, Cajanus cajan
MASKKITLKSSDGEAFEVEEAVALESQTIKHMIEDDCADSGIPLPNVTSKILAKVIEYCKKHVEATNNDEKPTDDELKAWDADFVKVDQATLFDLILAANYLNIKSLLDLTCQTVADMIKGKTPEEIRKTFNIKNDFTPEEEEEVRRENQWAFE

SEQ ID NO: 15036 - protein, 156 aa, Theobroma cacao
MSSSGRKITLKSSDGESFEVDEAVALESQTIKHMIEDDCADNGIPLPNVTSKILAKVIEYCKKHVEAPKTEDRTAEDELKNWDADFVKVDQATLFDLILAANYLNIKGLLDLTCQTVADMIKGKTPEEIRKTFNIKNDFTPEEEEEVRRENQWAFE

SEQ ID NO: 15037 - protein, 155 aa, Fagus grandifolia
MSSSKKITLKSSDGEAFEVEEAVALESQTIKHMIEDECADNGIPLPNVTSKILAKVIEYCKKHVEATNPDERTSDEDLKAWDAEFVKVDQATLFDLILAANYLNIKSLLDLTCQTVADMIKGKTPEEIRKTFNIKNDFTAEEEDEVRRENQWAFE

SEQ ID NO: 15038 - protein, 157 aa, Catharanthus roseus
MSSSKMIVLKSSDGETFEVDEAVALESQTIKHMIEDNCADTSIPLPNVTSKILAKVIEYCKRHVEASKSSDGEKSSDEDLKAFDADFVKVDQATLFDLILAANYLNIKSLLDLTCQTVADMIKGKTPEEIRKTFNIKNDFTPEEEEEVRRENAWAFE

SEQ ID NO: 15039 - protein, 155 aa, Castanea mollissima
MSSSKKITLKSSDGEAFEVEEAVALESQTIKHMIEDDCADNGIPLPNVTSKILAKVIEYCKKHVESTSSDERTSDEDLKAWDTEFVRVDQATLFDLILAANYLNIKSLLDLTCQTVADMIKGKTPEEIRKTFNIKNDFTPEEEEEVRRENQWAFE

SEQ ID NO: 15040 - protein, 156 aa, Nicotiana benthamiana
MSTSKMIVLKSSDGETFEVEEAVALESQTIKHMIEDDCANTSIPLPNVTSKILAKVIEYCKRHVDAVAKTDDKASEDDLKSFDADFVKVDQATLFDLILAANYLNIKSLLDLTCQTVADMIKGKTPEEIRKTFNIKNDFTPEEEEEVRRENAWAFE

SEQ ID NO: 15041 - protein, 155 aa, Cajanus cajan
MSSAKKITLKSSDGEAFEVEEAVALESQTIKHMIEDDCADSGIPLPNVTSKILAKVIEYCKKHVDAANPDDKPSEEDLKAWDTDFVKVDQATLFDLILAANYLNIKSLLDLTCQTVADMIKGKTPEEIRKTFNIKNDFTPEEEEEVRRENQWAFE

SEQ ID NO: 15042 - protein, 157 aa, Populus trichocarpa
MSTGRKFILKSSDGESFEVEEAVAVESQTIKHMIEDDCADNGIPLPNVTSKVLAKVIEYCKKHVESPKSDDRPSSAADDLKAWDAEFVKVDQATLFDLILAANYLNIKNLLDLTCQRVADMIKGKTPEEIRKTFNIKNDFTPEEEEEVRRENQWAFE

SEQ ID NO: 15043 - protein, 155 aa, Juglans hindsii x Juglans regia
MSSSKKITLKSSDGESFEVDEAVTLESQTIKHMIEDDCADNGIPLPNVTSKILAKVIEYCKKHVEPANSEDRTSEDDLKAWDMEFVRVDQATLFDLILAANYLNIKSLLDLTCQTVADMIKGKTPEEIRKTFNIKNDFTPEEEEEVRRENQWAFE

SEQ ID NO: 15044 - protein, 156 aa, Lupinus angustifolius
MSTSPKKITLKSSDGEAFEVDEVVAIESQTIKHMIEDDCADSGIPLPNVTSKILAKVIEYCKKHVDAAASEEKPNDDDLKAWDADFVKVDQSTLFDLILAANYLNIKSLLDLTCQTVADMIKGKTPEEIRKTFNIKNDFTPEEEEEVRRENQWAFE

SEQ ID NO: 15045 - protein, 54 aa, Cleome gynandra
MSGRKITLKSSDGETFEVDEAVALESQTIKHMIEDDCADNGIPLPNVTSKILSR

SEQ ID NO: 15046 - protein, 156 aa, Humulus lupulus
MSSSSKKIILKSSDGESFEVEEAVALQSQTIKHMIEDDCADNGIPLPNVTSKILAKVIEYCRKHVDSPNPDERVADDDLKSWDAEFVKVDQATLFDLILSANYLNIKNLLDLTCQTVADMIKGKTPEEIRKTFNIKNDFTPEEEEEVRRENQWAFE

SEQ ID NO: 15047 - protein, 156 aa, Panax ginseng
MSSTKITLKSSDGEVFEVDQAVALESQTIKHMIEDDCADNGIPLPNVSSKILSKVIEYCKKHVDAPAAEDRAVTADDDLKTFDADFVKVDQATLFDLILAANYLNIKSLLDLTCQTVADMIKGKTPEEIRKTFNIKNDFTPEEEEEVRRENQWAFE

SEQ ID NO: 15048 - protein, 156 aa, Panax ginseng
MTSTKITLKSSDGEVFEVDQAVALESQTIKHMIEDDCADNGIPLPNVTSKILSKVIEYCKKHVDAPAAEDRAVTADDDLKTFDADFVKVDQATLFDLILAANYLNIKSLLDLTCQTVADMIKGKTPEEIRKTFNIKNDFTPEEEEEVRRENQWAFE

SEQ ID NO: 15049 - protein, 153 aa, Acacia harpophylla
MSKKITLKSSDGEPFEVDEAVALESQTIKHMIEDDCADSGIPLPNVTSKILAKVIEYCKKHVDAANSEEKISEEDLRTWDADFVRVDQATLFDLILAANYLNIKSLLDLTCQTVADMIKGKTPEEIRKTFNIKNDFTPEEEEEVRRENQWAFE

SEQ ID NO: 15050 - protein, 163 aa, Silene vulgaris
MASEKKITLRSSDGETFEVEEIVAMESQTIKHMVEDDCADNVIPLPNVTSKILAKVIEYCKKHVDAEANKSAEATTVTAAAGDDELKNWDTEFVKVDQATLFDLILAANYLNIKSLLDLTCQTVADMIKGKTPEEIRKTFNIKNDFTPEEEEEVRRENQWAFE

SEQ ID NO: 15051 - protein, 151 aa, Nicotiana benthamiana
MIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKRLLDLTCQTVADMIKGKTPEEIRKTFNIKNDFTPEEEEEVRRENAWAFE

SEQ ID NO: 15052 - protein, 151 aa, Nicotiana tabacum
MIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKSLLDLTCQTVADMIKGKTPEEIRKTFNIKNDFTPEEEEEVRRENAWAFE

SEQ ID NO: 15053 - protein, 156 aa, Unknown
  Sequence found in Organisms: Gossypium hirsutum, Gossypium raimondii
MSSSGRKITLKSSDGESFEVDEAVALESQTIKHMIEDDCADNGIPLPNVTSKILAKVIEYCKKHVEAPKTDDRSADDELKSWDADFVKVDQATLFDLILAANYLNIKGLLDLTCQTVADMIKGKTPEEIRKTFNIKNDFTPEEEEEVRRENQWAFE

SEQ ID NO: 15054 - protein, 156 aa, Cannabis sativa
MSSSAKKIILKSSDGESFEVEEAVALQSQTIKHMIEDDCADNGIPLPNVTSKILAKVIEYCRKHVDSPNPDERVADDDLKSWDAEFVKVDQATLFDLILSANYLNIKNLLDLTCQTVADMIKGKTPEEIRKTFNIKNDFTPEEEEEVRRENQWAFE

SEQ ID NO: 15055 - protein, 167 aa, Antirrhinum majus
MSSSVENATKKITLRSSDGEVFEVEESLALESQTIKHMIEDDCADNVIPLPNVTGKILSKVIEYCKRHVDAAAAKADDKLASTGTSDDELKAFDADFVKVDQATLFDLILAANYLNIKTLLDLTCQTVADMIKGKTPEEIRKTFNIKNDFTPEEEEEVRRENQWAFE

SEQ ID NO: 15056 - protein, 166 aa, Antirrhinum majus
MSSSDNASKKITLRSSDGEVFEVDEAIALLSQTIKHMIEDDCADNVIPLPNVTGKILSKVIEYCKRHVDADAAKSEEKVAAAAAGDDDLKAFDADFVKVDQATLFDLILAANYLNIKTLLDLTCQTVADMIKGKTPEEIRKTFNIKNDFTPEEEEEVRRENQWAFE

SEQ ID NO: 15057 - protein, 155 aa, Unknown
  Sequence found in Organisms: Phaseolus vulgaris, Vigna unguiculata
MSSARKITLKSSDGEAFEVDEAVALESQTIKHMIEDDCADSGIPLPNVTSKILAKVIEYCKKHVDAANPDDKPSEEDLKAWDADFVKVDQATLFDLILAANYLNIKSLLDLTCQTVADMIKGKTPEEIRKTFNIKNDFTPEEEEEVRRENQWAFE

SEQ ID NO: 15058 - protein, 156 aa, Vitis vinifera
MSSSRKITLKSSDGEAFDVDEAVALESQTIKHMIEDDCADNGIPLPNVTSKILSKVIEYCKKHVEAPKPEERSGVDEELKAWDADFVKVDQATLFDLILAANYLNIKSLLDLTCQTVADMIKGKTPEEIRKTFNIKNDFTPEEEEEVRRENQWAFE

SEQ ID NO: 15059 - protein, 155 aa, Arachis hypogaea
MASTKKITLKSSDGEAFEVDEAVALESQTIKHMIEDDCADSGIPLPNVTSKILAKVIEYCKKHVDAAASEEKPSEEDLKMWDAEFVKVDQATLFDLILAANYLNIKSLLDLTCQTVADMIKGKTPEEIRKTFNIKNDFTPEEEEEVRRENQWAFE

SEQ ID NO: 15060 - protein, 157 aa, Amsonia hubrichtii
MSSSKMIVLKSSDGETFEVEEAVALESQTIKHMIEDNCADNSIPLPNVTSKILAKVIEYCKRHVEASKSSDGEKSSEEDLKGFDADFVKVDQGTLFDLILAANYLNIKSLLDLTCQTVADMIKGKTPEEIRKTFNIKNDFTPEEEEEVRRENAWAFE

SEQ ID NO: 15061 - protein, 155 aa, Cicer arietinum
MSSTRKFTLKSSDGEAFEVDEAVAVESQTIKHMIEDDCAGNGIPLPNVTSKILAKVIEYCKKHVEAATSDDKPTEDDLKAWDSDFVKVDQATLFELILAANYLNIKNLLDLTCMTVADMIKGKTPEEIRKTFNIKNDFTPEEEEEVRRENQWAFE

SEQ ID NO: 15062 - protein, 155 aa, Vigna unguiculata
MASTKKITLKSSDGEAFEVDEIVALESQTIKHMIEDDCADSGIPLPNVTSKILAKVIEYCKKHVEATSADEKPTEDELKAWDADFVKVDQATLFDLILAANYLNIKNLLDLTCQTVADMIKGKTPEEIRKTFNIKNDFTPEEEEEVRRENQWAFE

SEQ ID NO: 15063 - protein, 155 aa, Fagopyrum esculentum
MASPKKITLKSSDGETFEVEESVAVESQTIKHMIEDDCADNVIPLPNVTSKILAKVIEYCKKHVDTPKSEDRATEDDLKAWDAEFVKVDQATLFDLILAANYLNIKTLLDLTCQTVADMIKGKTPEEIRKTFNIKNDFTPEEEEEVRRENQWAFE

SEQ ID NO: 15064 - protein, 155 aa, Nicotiana benthamiana
MSSSKMIVLKSSNGETFEVEEAVALESQTIKHMIEDDCADTSIPLPNVTSKILAKVIEYCKRHVDATKAEDKASEDELKAFDSDFVKVDQATLFDLILAANYLNIKSLLDLTCQTVADMIKGKTPEEIRKTFNIKNDFTPEEEEEVRRENAWAFE

SEQ ID NO: 15065 - protein, 155 aa, Arachis hypogaea
MSSTRKITLKSSDGEAFEVDEAVALESQTIKHMIEDDCADSGIPLPNVTSKILAKVIEYCKKHVEAANAEERPNEEDLKTWDADFVKVDQATLFDLILAANYLNIKSLLDLTCQTVADMIKGKTPEEIRKTFNIKNDFTPEEEEEVRRENQWAFE

SEQ ID NO: 15066 - protein, 155 aa, Glycine max
MASTKKITLKSSDGEAFEVEEAVALESQTIKHMIEDDCADSGIPLPNVTSKILAKVIEYCKKHVEANSADEKPSEDVLKAWDVDFVNVDQATLFDLILAANYLNIKSLLDLTCQTVADMIKGKTPEEIRKTFNIKNDFTPEEEEEVRRENQWAFE

SEQ ID NO: 15067 - protein, 157 aa, Tabernaemontana elegans
MSSSKMIVLKSSDGETFEVEEAVALESQTIKHMIEDNCADSSIPLPNVTSKILAKVIEYCKRHVDASKSSDGEKSADEDLKAFDADFVKIDQGTLFDLILAANYLNIKSLLDLTCQTVADMIKGKTPEEIRKTFNIKNDFTPEEEEEVRRENAWAFE

SEQ ID NO: 15068 - protein, 160 aa, Glycine max
FLRLTKSFKCPLVFPTNFLFLLRGEVILNVKGLANFLWSLPLDHVGYSLTCKVQQALDVQVDEIEERGLVDLDEFSVPGLEIVLGGFVFGIRGLDVLLAVLDNLRQDLARHVRQRDAAVGAVVLDHVLYRLRLQRHRLLHLESLAVRTLQRDFLRRRHDE

SEQ ID NO: 15069 - protein, 155 aa, Glycine max
MASTKKITLKSSDGEAFEVEEAVAVESQTIKHMIEDNCADSGIPLPNVTSKILAKVIEYCKKHVEANCADEKPSEDELKAWDADFVKVDQATLFDLILAANYLNIKSLLDLTCQTVADMIKGKTPEEIRKTFNIKNDFTPEEEEEVRRENQWAFE

SEQ ID NO: 15070 - protein, 155 aa, Phaseolus vulgaris
MASTKKITLKSSDGEAFEVDEIVALESQTIKHMIEDDCADSGIPLPNVTSKILAKVIEYCKKHVEANSADEKPTEDELKAWDAEFVKVDQATLFDLILAANYLNIKNLLDLTCQTVADMIKGKTPEEIRKTFNIKNDFTPEEEEEVRRENQWAFE

SEQ ID NO: 15071 - protein, 155 aa, Fagopyrum esculentum
MASPKKITLKSSDGETFEVEESVAVESQTIKHMIEDDCADNVIPLPNVTSKILAKVIEYCKKHVDTPKSEDRAAEDDLKAWDAEFVKVDQATLFDLILAANYLNIKSLLDLTCQTVADMIKGKTPEEIRKTFNIKNDFTPEEEEEVRRENQWAFE

SEQ ID NO: 15072 - protein, 154 aa, Momordica charantia
SSSKKIILKSSDGEPFEVDEAVALESQTIRHMIEDDCADNGIPLPNVSSKILAKVIEYCRKHVDASNSEPRASEEDLKAWDRDFVNVDQATLFDLILAANYLNIKNLLDLTCQTVADMIKGKTPEEIRKTFNIKNDFTPEEEEEVRRENQWAFE

SEQ ID NO: 15073 - protein, 157 aa, Tropaeolum majus
MSSAGKKITLKSSDGETFEVDEAVALESQTIKHMIEDDCADNGIPLPNVTSKILSKVIEYCRKHVEAPKTEDRAAPEEDLKAWDADFVKVDQATLFDLILAANYLNIKSLLDLTCQTVADMIKGKTPEEIRKTFNIKNDFTPEEEEEVRRENQWAFE

SEQ ID NO: 15074 - protein, 155 aa, Carica papaya
MASTRKIVLKSSDGEAFEVDEAVALESQTIKHMIEDDCADNGIPLPNVTSKILSKVVEYCKKHVESPKADDRTADEELKNWDADFVKVDQATLFDLILAANYLNIKGLLDLTCQTVADMIKGKTPEEIRKTFNIKNDFTPEEEEEVRRENQWAFE

SEQ ID NO: 15075 - protein, 155 aa, Trigonella foenum-graecum
MSSTRKITLKSSDGETFEVDEAVALESQTIKHMIEDDCADSGIPLPNVTSKILAKVIEYCKKHVEAAAAEEKPSEDETKAWDAEFVKVDQATLFDLILAANYLNIKNLLDLTCQTVADMIKGKTPEEIRKTFNIKNDFSPEEEEEVRRENQWAFE

SEQ ID NO: 15076 - protein, 258 aa, Glycine max
MAINHETWAFIFGLLGNVISFMVFLAPLPTFYQIYKKKSTDGFQSLPYIVALFSSMLWIYYALVKKDASLLLITINSFGCVIETIYLAIFLIYAPSKTRLWTIKLLLMLNVFGFGAMLLSTLYLTTGSKRLSVIGWICLVLNISVFAAPLCIMKRVIKTKSVEFMPFSLSFFLTINAVMWFFYGLLLKDYYIALPNTLGFLFGIIQMVLYLIYRNAKPQGLEEPTKVQELNGHIIDVVKPNHVTKNGPVPVIETASNV

SEQ ID NO: 15077 - protein, 264 aa, Phaseolus vulgaris
MAIHHETWAFVFGLLGNVISFMVFLAPLPTFYQIYKKKTAEGFQSLPYVVALFSSMLWIYYALVKKDASLLLITINSFGCVIESIYLAIFLLYAPSKTRLCTIKLLLLLNVFGFGAMLLSTLYFTTGSKRLSVIGWICLVFNISVFAAPLCIMKRVIKTKSVEYMPFSLSFFLTINAVMWFFYGLLLKDYYIALPNTLGFLFGIIQMMLYLVYRNAKPKTLEEPTKLQELNGHIVDVVKLGTMAPSEPNHVTKSGAVTETATNV

SEQ ID NO: 15078 - protein, 264 aa, Vigna unguiculata
MAIHHETWAFVFGLLGNVISFMVFLAPLPTFYQIYKKKTAEGFQSLPYVVALFSSMLWIYYAMVKKDASLLLITINSFGCVIESIYLLIFLIYAPSKTRLSTIKLLLLLNVFGFGAMLLSTLYFTTGTKRLSVIGWICLVFNISVFAAPLCIMKRVIKTKSVEFMPFSLSFFLTVNAVMWFFYGLLLKDYYIALPNTLGFVFGIIQMVLYLVYRNAKPKTLEEPTKLQELNGHIVDVVKLGTVTPSEPNHVTKSGAVTETASNV

SEQ ID NO: 15079 - protein, 260 aa, Glycine max
MAINHETWAFVFGLLGNVISFMVFLAPLPTFYQIYKKKSTEEFQSLPYVVALFSSMLWIYYALVKKDASLLLITINSFGCVIETIYLAIFLIYAPSKTRLWTIKLLLMLNVFGFGAMLLSTLYLTTGSKRLTVIGWICLVFNISVFAAPLCIIKRVIKTKSVEFMPFSLSFFLTINAVMWFFYGLLLKDYYVALPNTLGFLFSIIQMVLYLIYRNAKTPDLPMKLQELNSHTIDVGKLSRMEPSEPNHLTKNGTLTEREI

SEQ ID NO: 15080 - protein, 260 aa, Glycine max
MAINHETWAFVFGLLGNVISFMVFLAPLPTFYQIYKKKSTEEFQSLPYVVALFSSMLWIYYALVKKDASLLLITINSFGCVIETIYLAIFLIYAPSKTRLWTIKLLLMLNVFGFGAMLLSTLYLTTGSKRLTVIGWICLVFNISVFAAPLCIIKRVIKTKSVEFMPFSLSFFLTINAVMWFFYGLLLKDYYVALPNTLGFLFSIIQMVLYLIYRNAKTPDLPMKLQELNSHTIDVGKLSRMEPSEPNHVTKNGTLTEREI

SEQ ID NO: 15081 - protein, 262 aa, Cajanus cajan
MAIHHETWAFIFGLLGNVISFMVFLAPLPTFYQIYKKKSTEGFQSLPYIVALFSSMLWIYYALVKKDASLLLITINTFGCVIETIYLVIFLVYAPNKTRLLTIKLLLLLNVFGFGAMLLSTLYLTTGSKRLSIIGWICLVFNISVFAAPLCIMKRVIKTKSVEFMPFSLSFFLTLNAVMWFFYGLLLKDYYIALPNTLGFVFGIIQMVLYLIYRNAKIPEPTKLQELNGGHIIDVVKMSTMVPSEPNHVARSDVVTETVSNV

SEQ ID NO: 15082 - protein, 282 aa, Glycine max
MAIHHETWAFVFGLLGNVISFMVFLAPLPTFYQIYKKKSSEGFQSLPYVVALFSSMLWIYYAFVKKDASLLLITINSFGCVIETIYLAIFLVYAPSKTRLWTIKLLLMLNVFGFGAMLLSTLYLTTGSKRLTVIGWICLVFNISVFAAPLCIMKRVIKTKSVEFMPFSLSFSLTINAVMWFFYGLLLKDYYIALPNTLGFLFGIIQMVLYLIYRNAKKDEPMKLEELNSHIINVGKLSRMEPSEPNHATKNGTVTEITIEDPNGKETEEGNLKNIMNSASNV

SEQ ID NO: 15083 - protein, 145 aa, Trigonella foenum-graecum
MQYLERRECEYDHKTLVNFYKEGDSLHPALTGVIVFTSTPDKENNIYYLGPAPLEDMARQIATANGPCGNNRDYLFLLEKAMHNLGHEDDLVIELANEVRKVLGVGNAVPIDKKLVGPAQLQHQPHVPISTLQLHPLPEPIALDS

SEQ ID NO: 15084 - protein, 224 aa, Cicer arietinum
MVFWVFGYGSLVWNPGFDYDEKIIGFIKDYRRVFDLACIDHRGTPENPARTCTLELKEGAICWGAAYCVRGGPEKEKQAMQYLERRECEYDHKTLVNFYKEGESLHPTLTGVIVFTSTPDKENNKYYLGPAPLEDMARQIATANGPCGNNRDYLFLLEKAMHNIGHEDDLVIELANEVRKVLEVVNVVPNDKILVGPTQLQHPSHLPISTLQLHPLPEPIALDS

SEQ ID NO: 15085 - protein, 224 aa, Glycine max
MVFWVFGYGSLVWNPGFDYDEKIIGFIKDYRRVFDLACIDHRGTPENPARTCTLEEKEGAICWGAAYCVRGGPEKEKLAMQYLERRECEYDRKTLVNFFKEGDSLHPTLTDVIVFTSTPDKVNNKYYLGPAPLEDMARQIATAYGPCGNNRDYIFLLEKAMHDIGHEDDLVIELANEVKKVLGVGNVVPKEKKQVGAAQLPHPPHVPIPTLQLLPLPEPIALDS

SEQ ID NO: 15086 - protein, 224 aa, Glycine max
MVFWVFGYGSLVWNPGFDYNEKIIGFIKDYRRVFDLACIDHRGTPENPARTCTLEEKEGAICWGAAYCVRGGPEKEKLAMQYLERRECEYDRKTLVNFFKEGDSLHPTLTDVIVFTSTPDKVNNKYYLGPAPLEDMARQIATAYGPCGNNRDYIFLLEKAMYDIGHEDDLVIELANEVRKVLGMGNVVPKEKKLVGAAQLPHPPHVTIPTLQLHPLPEPIAMDI

SEQ ID NO: 15087 - protein, 223 aa, Cyamopsis tetragonoloba
MVFWVFGYGSLVWNPGFEYEEKIIGFIKDYRRVFDLACIDHRGTPENPARTCTLELKEGTICWGAAYRFGGGPEKEKLAMQYLERRECEYDRKTLVNFYKEGDSLQPALTGVIVFTSTPDKENNKYYLGPAPLDDMARQIAFAHGPCGNNRDYLFLLEKAMHDLGHEDDLVIELANEVRKVLGVGNVVPKDKKLVGAGQLHHTPHVPIPTLQLHPLPEPIALA

SEQ ID NO: 15088 - protein, 224 aa, Cajanus cajan
MVFWVFGYGSLVWNPGFDFDEKIVGFIKDYRRVFDLACIDHRGTPEKPARTCTLEQKEGAICWGAAYCVRGGPEKEKLAMQYLERRECEYDQKTIVSFFKEGDSLHPTLTDVIVFTSTPDKVNNKYYLGPAPLDDMAWQIATAYGPCGNNRDYLFLLEKAMYDIGHEDDLVIELANEVRKVLGVGNVVSKEKKSVGPAQLAHPPHVPIPSRQLHPMPEPIALDS

SEQ ID NO: 15089 - protein, 220 aa, Phaseolus vulgaris
MVFWVFGYGSLVWNPGFDYDEKMIGFIKDYRRVFDLACIDHRGTPESPARTCTLEEKEGAICWGTAYCVRGGPEKEKLAMQYLERRECEYDRKTLVTFFKEGDSQHPALTDVIVFTSTPDKVNNKYYLGPAPLEDMARQIATAYGPCGNNRDYLFLLEKAMYEIGHEDDLVIELANEVRKALGVGKVLPNVGAAQLPHPPHVSIPSRQLQPLPEPIAMDG

SEQ ID NO: 15090 - protein, 224 aa, Lotus japonicus
MVFWVFGYGSLVWNPGFEYDEKVIGYIKDYRRVFDLACIDHRGTPEHPARTCTLEEKEGEICWGAVYCVRGGPEKEKLVMQYLERRECEYDHKTLVDFYKEGDSSHPALTGVIVFTSTPDKVNNKYYLGPAPLDVMARQIATAHGPCGNNRDYLFLLEKAMHNIGHEDDMVIELAHEVRKVLGVGNVLPNDKKLSGPVQIQHSPHAPIPALQLLPMPEPIALDS

SEQ ID NO: 15091 - protein, 220 aa, Vigna unguiculata
MVFWVFGYGSLVWNPGFDYDEKIVGFIKDYRRVFDLACIDHRGTPENPARTCTLEEKEGAICWGAAYCVRGGLEREKLAMQYLERRECEYDRKTLVTFFKEGDSQHPALTDVIVFTSTPDKVNNKYYLGPAPLEDMARQIATAYGPCGNNRDYLFLLEKAMYDIGHEDDLVIELANEVRKALGVGNVLPNVATAQLPHPPHVSIPSRQLQPLPEPIALDG

SEQ ID NO: 15092 - protein, 225 aa, Arachis hypogaea
MVFWVFGYGSLVWNPGFEFDEKIIGYIKDYRRVFDLACIDHRGTPESPARTCTLEEKEGAICWGAAYCVKGGAEKEKFAMQYLERRECEYDQKTLVNFYKEGETLQPALTGVIVFTSTPDKINNKYYLGPAPLEDMARQIATAYGPCGNNRDYLFLLEKAMYDIGHEDDYVIELANEVRKVLGMGKALPKDKKLVGAPSQLQHPPHVPIPTLQLHPLPEPIALDS

SEQ ID NO: 15093 - protein, 225 aa, Arachis hypogaea
MVFWVFGYGSLVWNPGFEFDEKIIGYIKDYRRVFDLACIDHRGTPESPARTCTLEEKEGAICWGAAYCVKGGAEKEKFAMQYLERRECEYDQKTLVNFYKEGETLQPALTGVIVFTSTPDKINNKYYLGPAPLEDMARQIATAYGPCGNNRDYLFLLEKAMYDIAHEDDYVIELANEVRKVLGMGKALPKDKKLVGATSQLQHPPHVPIPTLQLHPLPEPIALDS

SEQ ID NO: 15094 - protein, 222 aa, Fagus grandifolia
MVFWVFGYGSLVWNPGFDYDEKVIGFIKDYRRVFDLACIDHRGTPEHPARTCTLEQKEGDICWGAAYCVRGGPERERLAMEYLERRECEYDEKTLVNFYKEGDSLQPALTGVIVFTSTPDKESNKYYLGPAPLEEMARQIATAYGPCGNNRDYIFQLEKAMSAIGHEDDMVIELANEVRKVLGIEGIPKERKLVGPSHIPLTSHIPTLQLHPLPEAIAMDSS

SEQ ID NO: 15095 - protein, 518 aa, Sorghum bicolor
MVDTVAGATDYRGQPASRAATGGWKPSVFVMAMEIAERFAYKGVAANLITYLTGPLGQPMARAAASIDAWKGVSQMLPLPLACVADAWLGRYRAIVLASLIFVVSMGSLSLSAALPALRGGHVAIFYVALYLVALGEGAHKPCAQAFAADQYDEKDPKESVARSSFFNWWYFGMCAGTAVTTMVSSYVQDNVGWGLGFGIPCIVIVASLALFLLGTRSYRFYTTTEASPFSRVGNALLALIHSWAPKHRTRKLGDGDEDNAVAVEEVKSVLRLLPIWASCIIYAIIFSQTSTFFTKQAATLDRRIGARFKVPPAALQTFISVSIVVFIPVYDRLFVPLARRYTGRPTGITMLQRVGAGLALSLVAVALSALVEMKRLRVATEAGLVNTPKAQLPMTLWWMVPQYILIGVADVFAMIGLQEFFYDQVPDAVRSLGLALFLSIFGVGHLLSSLLISVIDKTTARSGTSWFSNNLNRAHLDYFYWLLTGLCAVELVAFVLFSRVYAYKRKSGNDGGSGDLV

SEQ ID NO: 15096 - protein, 517 aa, Zea mays
MVDTVAGATDYRGQPASRAATGGWKPSVFVMAMEIAERFAYKGVAANLITYLTGPLGQPMARAAASIDAWKGVSQMLPLPLACVADAWLGRYRAIVLASLIFAVSMGALSLSSALPALRGGHVAIFYVALYLVALGEGAHKPCAQAFAADQFDEKDPRESVARSSFFNWWYFGMCAGTAVTTMVSSYVQDNVGWGLGFGIPCIVIVASLALFLLGTRSYRFYTTAAASPFSRVGKALLALVQSWAPKHRTRKLGDSDGDAVAVEEVKSVLRLLPIWASCIIYAIIFSQTSTFFTKQAATLDRRIGARFKVPAAALQTFISVSIVVFIPVYDRLFVPLARRYTGRPTGITMLQRVGAGLALALVAVALSALVEMKRLRVAAEAGLVNTPKAQLPMALWWMVPQYVLIGVADVFAMIGLQEFFYDQVPNAVRSLGLALFLSIFGIGHLLSSFLISVIDKTTAKSGTSWFSNNLNRAHLDYFYWLLTGLCAVELVAFVIFSRVYVYKRKVGNDGGNGDFV

SEQ ID NO: 15097 - protein, 531 aa, Setaria italica
MCHRSELLSLVLIQPAMADNVAGAADYRGQPASRAATGGWKSSVFVMAMEIAERFAYKGVAANLITYLTGPLGQPMARAAASIDAWKGVSQMLPLPLACVADAWIGRYRAIVLASLIFVVSMGALSVSSAFPAFRGGHVAIFYVALYLVALGEGAHKPCAQAFAADQFDEKDPEESVARSSFFNWWYFGMCAGTAATTMISSYVQDNVGWGLGFGIPCIVIAASLAVFLLGSRSYRYYTTSEARPFSRVGKAFLALVESWTPNRRVRSKGEGNAAAVEEVKSVLRLLPIWASCIIYAIIFSQTSTFFTKQAATLDRRIGARFKVPPAALQTFISLSIVVFIPAYDRLFVPLARRYTGRPTGITMLQRIGAGLALSLAAVALSALIEMRRLGVARDAGLVSTPKAQLPMSLWWMVPQYVLIGVADVFAMIGLQEFFYDQVPDAARSLGLALFLSIFGVGHLLSSLLISVIDKATAKSGTSWFSNNLNRAHLDYFYWLLTGLCAVDLVAFVFFARVYVYKRKGGDGDGDGDAV

SEQ ID NO: 15098 - protein, 469 aa, Setaria italica
MCHRSELLSLVLIQPAMADNVAGAADYRGQPASRAATGGWKSSVFVMAMEIAERFAYKGVAANLITYLTGPLGQPMARAAASIDAWKGVSQMLPLPLACVADAWIGRYRAIVLASLIFVVSMGALSVSSAFPAFRGGHVAIFYVALYLVALGEGAHKPCAQAFAADQFDEKDPEESVARSSFFNWWYFGMCAGTAATTMISSYVQDNVGWGLGFGIPCIVIAASLAVFLLGSRSYRYYTTSEARPFSRVGKAFLALVESWTPNRRVRSKGEGNAAAVEEVKSVLRLLPIWASCIIYAIIFSQTSTFFTKQAATLDRRIGARFKVPPAALQTFISLSIVVFIPAYDRLFVPLARRYTGRPTGITMLQRIGAGLALSLAAVALSRAHRDETARRREGRRPGEHPEGPAPHEPLVDGPAVRPHRRRRRVRHDRAAGVLLRPGPRRGAQPWASPVPEHLRGRAPPQQPPHLRH

SEQ ID NO: 15099 - protein, 536 aa, Panicum virgatum
MPDRSELVSLVLIQPAMADTVAGAADYRGKPASRSTTGGWKSSAFVMAMEIAERFAYKGVAANLITYLTGPLGQPVARAATSIDAWKGVSQMLPLPLACLADAWIGRYRAIVLASLIFVVSMGALSVSSAFPAFRGGHVAIFYVALYLVALGEGAHKPCAQAFAADQFDEKDPRESVARCSFFNWWYFGMCAGTAVTTMVSSYVQDNVGWGLGFGIPCIVIAASLAVFLLGSRSYRYYTTTEASPFSRVGKAFMALIESRTNRRTSSISKGDGNAAAAVEEVKSVLRLLPIWASCIIYAIIFSQTSTFFTKQAATLDRRIGARFKVPPAALQTFISVSIVVFIPVYDRLFVPLARRCTGRPTGITMLQRIGAGLALSLVAVALSALVEMKRLGVARDAGLVNTAKAQLPMSLWWMVPQYVLIGVADVFAMIGLQEFFYDQVPDAARSLGLALFLSIFGVGHLLSSLLISVIDKATAKSGTSWFSNNLNRAHLDYFYWLLTGLCAVELVAFVFFSRVYVYKRKSGNDDAGNGDGDFV

SEQ ID NO: 15100 - protein, 519 aa, Panicum virgatum
MADTVAGAADYRGQPASRAATGGWKSSAFVMAMEIAERFAYKGVAANLITYLTGPLGQPVARAAASIDAWKGVSQMLPLPLACLADAWIGRYRVIVLASLIFVVSMGALSVSSAFPVFRGGHVAIFYVALYLVALGEGAHKPCAQAFAADQFDEKDPRESVARSSFFNWWYFGMCAGTAVTTMVSSYVQDNVGWGLGFGIPCIVIAASLAVFLLGSRSYRYYTTTEASPFSRVGKAFMALIESWTPNRRESIRKGDGDSAAVEEVKSVLRLLPIWASCIIYAIIFSQTSTFFTKQAATLDRRIGARFKVPPAALQTFISVSIVVFIPVYDRLFVPLARRCTGRPAGITMLQRIGAGLALSLVAVALSALVEMKRLGVARDAGLVNTPKAHLPMSLWWMVPQYVLIGVADVFAMIGLQEFFYDQVPGAARSLGLALFLSIFGVGHLLSSLLISVIDKATAKSGMTWFSNNLNRAHLDYFYWLLTGLCAVELVAFVFFSRVYVYKTKSGNDDAGDCDGYFV

SEQ ID NO: 15101 - protein, 548 aa, Oryza sativa
MADHRSKLVSHLLDSGMADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 15102 - protein, 528 aa, Brachypodium distachyon
MGDTVSGAADYRGQPASRAATGGWKSSIFVMAMEIAERFAYKGVASNLIQYLTGPLGQPMARAAASIDAWKGVSQMLPLPLACIADAWLGRYRAIVLASILFILSMGTLSLSSAVRIFGAGGHVAVFYVALYLVALGEGAHKPCAQAFAADQFDDKDPKESVARSSFFNWWYLGMCSGTAVTIMVSSYVQDNVGWGLGFGIPCIVIAVSLAVFLLGTRSYRYYTTKEPSPVARVGKAFFTLIKSWRSKHRTNPASSAKVEGGDSAEDLVEEVKSVFRLLPIWASCIIYAIIFSQTSTFFTKQAATLDRRIGPSFKVPPAALQTFISISIVVFIPVYDRLFVPLARRYTGRPSGITMLQRVGVGLALSLAAVVLSALVEMKRLRVASAAGLVNTPKTQLPMTLWWMVPQYILIGVSDVFAMIGLQEFFYDQVPDAVRSLGLALFLSIFGVGHLLSSFLISVIDGATKKNGASWFSNNLNKAHLDYFYWLLAGLCAVELVAFLFFSRLYVYKKKAGDGDYRGDDPDAIVV

SEQ ID NO: 15103 - protein, 532 aa, Oryza sativa
MADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 15104 - protein, 377 aa, Zea mays
MATASLLEATRLLSTPRPPRRSLHTHLLRTPRLSALRAHLHRSATLDAQEPTARPGALLVLDALRRSVVDSLAALKRPALALLLAGALLAAASMGGPHAAALAASGGRVGGSAFSSRSSSPPSYGYSAPAPRGGYTAAPYYSPSPFVSFGPAVGIGFGGSGFLVTLIGFAAFLYLAGFLSDSSGGTSVLTETDKTTVLKLQVGLLGMARSFQKELDQIAEKADTSTPAGLSYVLTETTLALLRHPDCCISAYSSVDVKRSVDDGEKRFNQLSIEERGKFDEETLVNVNSIKRNKGGSQRSSGFSNEYIVITILVAAEGVHKLPVINSSNDLKTALQKMGAIPSSKILAVEVLWTPQNENDTLSERELLEDYPLLRPL

SEQ ID NO: 15105 - protein, 390 aa, Sorghum bicolor
MAAASLLEATRLLSTPRPLPLPPRRGLQPHHHHRTPPRVSALRAHLHRPAAPLDAQQQEQLAARRPGALLVLDALRRSVLDALVALKRPALALLLAGALLAASAGGPHAAALAASGGRVGGSAFSSSRSSSSHSSYGYSAPAPRGGGYRAAPFYSPSPFVSVGPAIGIGFGGSGFLFTLIGFAAFLYLAGFLSDSSGGASVLTETEKTTVLKLQVGLLGMARSFQKELDQIAEKSDTSTPAGLSYVLTETTLALLRHPDCCISAYSSVDVKRSMDDGEKRFNQLSIEERGKFDEETLVNVNSIKRNKGGSQRSSGFSNEYIVITILVAAEGVHKLPVINSSNDLKTALQKMGAIPSSKILAVEVLWTPQNENDTLSERELLEDYPLLRPL

SEQ ID NO: 15106 - protein, 390 aa, Sorghum bicolor
MAAASLLEATRLLSTPRPLPLPPRRGLQPHHHHRTPPRVSALRAHLHRPAAPLDAQQQEQLAARRPGALLVLDALRRSVLDALVALKRPALALLLAGALLAASAGGPHAAALAASGGRVGGSSFSSSRSSSSHSSYGYSAPAPRGGGYRAAPFYSPSPFVSVGPAIGIGFGGSGFLFTLIGFAAFLYLAGFLSDSSGGASVLTETEKTTVLKLQVGLLGMARSFQKELDQIAEKADTSTPAGLSYVLTETTLALLRHPDCCISAYSSVDVKRSMDDGEKRFNQLSIEERGKFDEETLVNVNSIKRNKGGSQRSSGFSNEYIVITILVAAEGVHKLPVINSSNDLKTALQKMAAIPSRKILAVEVLWTPQNENDTLSERELLEDYPLLRPL

SEQ ID NO: 15107 - protein, 388 aa, Setaria italica
MAAASLLEATRLLSSPLPRPRPPLLPPHRGLRLLLGPARLPALRAHHRLPPPAAAEEDEPARPQPQPLLALDALRRSVLDSLAALKRPALALLLAGALLAAAPAVVGPHAAALAASGGRVGGSAFSSRSSSPPSYGYSAPVPRGGYTSAPFYSPSPFVSVGPAVGIGFGGSGFLMALMGFAAFLYLAGFLSDSPGNGSVLTETQKTTVLKLQVGLLGMARSFQKELDQIAEKADTSTPAGLSYVLTETTLALLRHPDCCISAYSSVDVKRSMDDGEKRFNQLSIEERGKFDEETLVNVNSIKRNKAGSQRSSGFSNEYIVITILVAAEGVYKLPVINSSNDLKTALQNLGGIPSSKILAVEVLWTPQNENDTLSERELLEDYPLLRPL

SEQ ID NO: 15108 - protein, 364 aa, Brachypodium distachyon
MAAASLLESTRFLSLPPPRSLPPRRGLHLLSPSSPLPERDLAPRLRDPLLDALKKSLSDTLAALKKPALALLLAGALLAAAGPHHAALAASGGRVGGSAFSSRSSRSSPSYGYTAPAPRGGYSAAPFYSPSPFVSVGPAVGIGFGGSGFLLTLVGFAAFLYLAGFLSDSSGGGSVLTETQKTTVLKLQVGLLGMARSFQKELDQIAEKADTSTPSGLSYVLTETTLALLRHPDCCISAYSTVDVKRSIDDGEKRFNQLSIEERGKFDEETLVNVNSIKRQKAGSQRSSGFSNEYIVITILVAAEGVHKLPTINSSSDLKTALQKLGAVPSSKILAVEVLWTPQNENDTLSERELLEDYPLLRPL

SEQ ID NO: 15109 - protein, 622 aa, Arabidopsis thaliana
MRKQFVFLLPFLSRLYHVVIAGGERLTNGGFSPEINPFTPKASLVRYWNKQIHHQSPGSAFLLSKASPLTAVASATFAKLASENALPDRLPDFCSAANLFCFPDLGPTLEKHSNDVKFSVYDQRNFTNYGTIHPGGADSFKKYSQNGNAVTDSFRRYSRDAAGHEDKFTGYADNSNVVEEKFNSYGTSATGGSGDFKNYQSGVNNPTTRFKAYSDEGNGRAQTFKTYTHEANSGPGQSFTSYGKNGNGAPNEFSSYGVSSNVIGSDFSNYGENGNAANDTFKGYGGDGNVPQNNFKSYGASGNAAVDTFLNYRDNANVGDDSFSSYAKNSNFEKVDFVNYGKSINPGSESFSGYGKGAEGNKIDFKTYTQNSTFKDYTKTGVEFAKYNRSSLGGGKTVNKWVEPGKFFRESMLKEGTLIWMPDIKDKMPKRSFLPRSIVSKLPFSTSKIAEIKRVFHANDNSTMEGIITDAVRECERPPTVSETKRCVGSAEDMIDFATSVLGRSVVLRTTESVAGSKEKVMIGKVNGINGGRVTKSVSCHQSLYPYLLYYCHSVPKVRVYESDLLDPKSKAKINHGIAICHMDTSAWGANHGAFMLLGSRPGQIEVCHWIFENDMNWAIAD

SEQ ID NO: 15110 - protein, 338 aa, Brassica napus
LILLSSSMLFSSVGTVNWSVGFSAEENPFTPKASLVRYWNKEISADKSLRSEFLISKASPLNAVDSATFAKLAAQNSLPTRLPDFCSAANLFCFPDLTPSLEKHDDNVKFSVYDQKNFTSYGNARAAGADSFKTYSKGNNGAFDSFRRYSRNAAGHEDKFTVYGERGNVDEKDFNSYGTFAAGGAGDFTNYQNDVNDPMSRFTAYSDGGTGRSQTFKTYTHDANAGNGQSFTSYSKKGNTSPNEFASYGDSSNVIGSDFKNYGEEENAAKDTFTSYASGGNVPLNNFKTTASPLTPPTIPSLTTEETAGMYRRTTSKATASPVTMPSTLSRTTEIKPT

SEQ ID NO: 15111 - protein, 623 aa, Arabidopsis lyrata
MLKNFVFLLPFLSRLFHVVMAGGERLTNGGFSPEMNPFTPKASLVRYWNKQIQHQSPGSAFLLSKASPLTAVASATFAKLASENALPDRLPDFCSAANLFCFPDLGPTLEKHSNDVKFSVYDQRNFTNYGGTIHPGGADSFKKYSQNGNVVTDSFRRYSRDAAGHEDKFTGYADNSNVVEENFNSYGTSATGGSGDFKNYQSGVNNPTSRFKAYSDDGNGRAQTFKTYTHEANAGPGQSFTSYGKNGNGAPNEFSSYGVSSNVIGSDFSNYGENSNAANDTFKGYGGDGNVPRNNFKSYGASGNAAVDTFLNYRDKANVGDDSFASYAKNSNFEKVDFVNYGKSINPGSESFTGYGKGAEGNKIGFKTYTQNSTFKDYAKTGVEFAKYNQSRLGGGKTVNKWVEPGKFFRESLLKESSLIWMPDIKDKMPKRSFLPRNIVSKLPFSTSKIAEIKRVFHAKDNSTMAGIITDAVTECERSPTIGETKRCVGSAEDMIDFATSVLGRNVVLRTTESVAGSKQKVMIGKVKGINGGRVTKSVSCHQSLYPYLLYYCHSVPKVRIYESDLLDPKSKAKINHGIAICHMDTSAWGANHGAFMSLGSRPGQIEVCHWIFENDMNWAIAD

SEQ ID NO: 15112 - protein, 422 aa, Eutrema parvulum
MASVISLSLTSGTTRLRSNSLHKSKLTPQHLRHISCSRHSYSSSTREISLKSRSSFDRATTVPISCRPSVDFFPRCGISSNDFPTERKKSFGEWVGFVGEAVSTAFPLWVSLGCLLGLMKPSAFNWVTPKWSIIGLTITMLGMGMTLTLDELRGALKMPKELFAGFALQYSVMPLSAFLVSKLLNLPPPYAAGLILVGCCPGGTASNIVTYIARGNVALSVLMTAASTLSAVIMTPLLTAKLAKQYVAVDALGLVMSTLQVILLPVLAGAFLNQYFQSVVKFVSPLMPPIAVGTVAILCGTAIGQNASAILTSGTQVVLASILLHVSGFLFGYLFSRFLRIDVASSRTISIEVGMQNSVLGLVLAAQHFGNPLTAVPCAVSSVCHSIIGSALAGIWRRSGPKQFEDLKETKVGISPSQDHLV

SEQ ID NO: 15113 - protein, 422 aa, Eutrema parvulum
MASVISLSLTSGTTRLRSNSLHKSKLTPQHLRHISCSRHSYSSSTREISLKSRSSFDRATTVPISCRPSVDFFPRCGISSNDFPTERKKSFGEWVGFVGEAVSTAFPLWVSLGCLLGLMKPSAFNWVTPKWSIIGLTITMLGMGMTLTLDELRGALKMPKELFAGFALQYSVMPLSAFLVSKLLNLPPPYAAGLILVGCCPGGTASNIVTYIARGNVALSVLMTAASTLSAVIMTPLLTAKLAKQYVAVDALGLVMSTLQVILLPVLAGAFLNQYFKKLVNFVSPVMPPIAVGTVAILCGYAIGQNASAILMSGKQVVLASTLLHVSGFLFGYLFSRLLGIDVASSRTISIEVGMQNSVLGVVLATQHFGNPLTAVPCAVSSVCHSIIGSALAGIWRRSGPKQFEDLKETKVGISPSQDHLV

SEQ ID NO: 15114 - protein, 401 aa, Arabidopsis thaliana
MASAISLSLLNGATPLKSNSLHKSRLTPLHLRTISCSRLSYSPSSREISLKTQSTVPISCRRSRFDFVPRCGISSNDLPTEKKKSFGEWVEFVGEAVSTAFPIWVSLGCLLGLMRPSTFNWVTPNWTIVGLTITMLGMGMTLTLDDLRGALSMPKELFAGFLLQYSVMPLSAFFVSKLLNLPPHYAAGLILVGCCPGGTASNIVTYIARGNVALSVLMTAASTVSAVIMTPLLTAKLAKQYITVDALGLLMSTLQVVLLPVLAGAFLNQYFKKLVKFVSPVMPPIAVGTVAILCGYAIGQNASAILMSGKQVVLASCLLHISGFLFGYLFSRILGIDVASSRTISIEVGMQNSVLGVVLATQHFGNPLTAVPCAVSSVCHSILGSVLAGIWRRSAPKQLED

SEQ ID NO: 15115 - protein, 399 aa, Arabidopsis lyrata
MAAISLSLVNGATPLKSNSLHKSKLTPLHLRTISFSRLSYSSSSREISLKTQSTVPISCRRRFDFVPRSGISSNDLPTEKKKSFGEWVEFVGEAVSTAFPIWVSLGCLLGLMRPSTFNWVTPNWTIAGLTITMLGMGMTLTFDDLRGAFSMPKELFAGFVLQYSVMPLSAFFVSKLLNLPPHYAAGLILVGCCPGGTASNIVTYIARGNVALSVLMTAASTVSAVIMTPLLTAKLAKQYITVDALGLLMSTLQVVLLPVLAGAFLNQYFQKLVKFVSPVMPPVAVGTVAILCGYAIGQNASAILRSGKQVVLASCLLHISGFLFGYLFSRLLGIDVASSRTISIEVGMQNSVLGVVLATQHFGNPLTAVPCAVSSVCHSILGSALAGIWRRSAPKQIED

SEQ ID NO: 15116 - protein, 402 aa, Eutrema halophilum
MASAIYLSLSNVTTPLKSTSLHKSKLTPLHLRLISSSYASSNRETSLGLRSSFDRATVPVSCRRRFDFLPRCGISSNDFPAERKKSFGEWVEFVGEAVSTAFPVWVSLGCLLGLMRPSTFNWVTPNWTIVGLTITMLGMGMTLTLDDLRGALKMPKQLFAGFLLQYSVMPLSAFLVSKLLNLPSHYAAGLILVGCCPGGTASNIVTYIARGNVALSVLMTAASTVSAVIMTPLLTAKLAKQYITVDALGLLMSTLQVVLLPVLAGAFLNQYFKKLVNFVSPVMPPIAVGTVAILCGYAIGQNASAILMSGKQVVLASTLLHVSGFLFGYLFSRLLGIDVASSRTISIEVGMQNSVLGVVLATQHFGNPLTAVPCAVSSVCHSILGSMLAGVWRRSAPKQIEN

SEQ ID NO: 15117 - protein, 404 aa, Theobroma cacao
MQSSLSCPQATTNFKFQLKSRTISTYEPPHQHLFISFPKPSNSSPFDLTLRSQSHEPPKRTATSLTSKRFQLQCSISSESYNLNNEKSFGDWVEWLGEVISTAFPIWVSLGCLFGLLKPTSFSWVTPRWNIFGLTLTMLGMGMTLTLDDLRGALAMPKELISGFVLQYSVMPLSGFLVSKLLNLPSHYAAGLILVGCCPGGTASNIVTYIARGNVALSVLMTAASTLSAVIMTPFLTAKLAGQYVAVDAAGLLISTLQVVLLPVLAGAFLNQYFQGLVKFVSPLMPPIAVGTVAILCGNAIAQSASAILASGQQVVLASSLLHASGFFFGYILSRVLGLEVASSRTISIEVGMQNSVLGLVLASQHFQNPLTAVPCAVSSVCHSIFGSILAGIWRRTVPKQKQE

SEQ ID NO: 15118 - protein, 423 aa, Prunus persica
MRSSLSHPHGNTGFKFHSNPISNQSPLTAISFPFSHYTKTSPSPSASIQLTLRSQYDLRAQFPSKPTWLLPSVSFPPTLATKTGRSLAPLQCGILSNSCSTDDGKRSFRDWVEVVGEAVSTAFPIWVALGCLLGLIKPSSFNWVTPNLTILGITLTMLGMGMTLTFNDLRGALAMPKELLAGFVLQYSVMPLSGYAVSKLLNLPSYYAAGLILVGCCPGGTASNIVTYIARGNVALSVLMTAASTLSAVIMTPFLTAKLAGQYVAVDAAGLLFSTLQVVLLPVLAGAFLNQYFQGLVKFVSPLMPPIAVGTVAVLCGNAIAQSSSAILMSGKQVVLAAALLHASGFFFGYILSRILGIDVSSSRTISIEVGMQNSVLGVVLASQHFGNPLTAVPCAVSSVCHSILGSALAGIWRQSVPTQKQD

SEQ ID NO: 15119 - protein, 424 aa, Prunus mume
MPSSLSHPHGNTGFKFQSNPISNQSPLTAISFPFAHYTKTSPYPSAFIQLTLRSQYDLRPQFPSKPTWLLPSVSFPPTLATKTGRSSLAPLQCGILSNSCSANDGKRSFRDWVEVVGEAVSTAFPIWVALGCLLGLIKPSSFNWVTPNLTILGITLTMLGMGMTLTFDDLRGALAMPKELLAGFVLQYSVMPLSGYAVSMLLNLPSYYAAGLILVGCCPGGTASNIVTYIARGNVALSVLMTAASTLSAVIMTPFLTAKLAGQYVAVDAAGLLFSTLQVVLLPVLAGAFLNQYFQGLVKFVSPLMPPIAVATVAVLCGNAIAQSSSAILMSGKQVVLAAALLHASGFFFGYVLSRILGIDVSSSRTISIEVGMQNSVLGVVLASQHFGNPLTAVPCAVSSVCHSILGSALAGIWRQSVPTQKQD

SEQ ID NO: 15120 - protein, 404 aa, Ricinus communis
MASSLPFSPVGTCSFSSRPKSYAPTTKLHPFLFASSVKSISKLQLQSNQIQAAPSKPNWILLSATKRAAQLLHCGISSNDLSANTDKSFRDWIVVIGEAISTAFPLWVSLGCILALIKPTSFNWVTPKWTILGISLTMLGMGMTLSFDDLKAALAMPKEIFSGFVLQYSVMPLSGFLVSKILNLPSHYAAGLILVGCCPGGTASNIVTYIARGNVALSVLMTAASTLTAVVMTPFLTAKLAGQYVAVDAVGLLMSTLQVVLLPVLAGAFLNQYFQGLVKFVSPVMPPIAVGTVAILCGNAIAQSASAILMSGQQVVLAASLLHASGFFFGYTLARMLGLDVASSRTISIEVGMQNSVLGVVLATQHFGNPLTAVPCAVSSVCHSVFGSLLAGVWRRSLPTQNKD

SEQ ID NO: 15121 - protein, 137 aa, Eutrema parvulum
MGCIGIVNVTNINPYRPVLTRRANQLHNSRGPSMAAIRAESMATEKLGITIEKNPSESKLTQLGVRKWPKWGCPPSKFPWTYDAKETCYLLEGKVKVYPDGYDEGVEIEAGDFVVFPKGMSCTWDVSVAVDKHYQFE

SEQ ID NO: 15122 - protein, 699 aa, Cajanus cajan
MLVGLLPPTSGDALVFGKNIVSDIDEIRKVLGVCPQHDILFPELTVREHLELFAILKGVEEHSLDNVVTNMADEVGLADKINSIVRTLSGGMKRKLSLGIALIGNSKVIVLDEPTSGMDPYSMRLTWQLIKKIKKGRIILLTTHSMDEAEELGDRIAIMANGSLKCCGSSLFLKHHYGVGYTLTLVKSAPTASIAGDIVYRHVPSATCISEVGTEISFRLPMASSSAFEGMFREIEGYMKKPISNMELSGNGDKDSLGIESYGISVTTLEEVFLRVAGCDYDEVECFEENNHSLISDSVASLPTNDHPSTKTSCLKIFGNYKKILGFMSTMLGRACGLIFATVISFINFLGMQCCSCCLITRSTFWQHFKALFIKRAISARRDHKTIIFQLMIPTLFLFIGLLFLKLKPHPDQQSLTLSTSHFNPLLSGGGGGGPIPFNLSLPIAEKVAQNVKGGWIQRFKPSSYRFPNSEKALADAVEAAGPALGPALLSMSEYLMSSFNESYQSRYGAIVMDDQNNDGSLGYTVLHNCSCQHAAPTFINLMNSAILRLATMDMNMTIQTRNHPLPTTQSQHLQRHDLDAFSAAIIVNIAFSFIPASFAVSIVKEREVKAKQQQLISGVSVLSYWASTFIWDFVSFLFPASFAIVLFYIFGLDQFVGGVSLLPTILMLLEYGLAIASSTYCLTFFFFDHTLSHRTWFS

SEQ ID NO: 15123 - protein, 2142 aa, Medicago truncatula
MGTASRQLKVMLRKNYLLKIRHPFVTAAEILLPAIVLMLLAAVRTQVDTQIHPAQSVKVAPIIEKMLENRLRWFGDVERRPIDFVTGRVDHMENSQITRGLVVVVVLREWMHIQKDMFVEVGKGVSPNFQQVLESLLDKREYLAFVPDTNETRMMIDVVSIKFPILKHVSIVYNDELELETYIRSDAYGTCNDVRNCSNPKIKGAVVFHEQGPQSFDYSIRLNHTWAFSGFPDVTTIMDTNGPFLNDLELGVSAVPTMQYSLSGFLTDSVPNIIITDIMISSAQTSGTVSLPSELPESYHRHYGMYKSSKPKMERLLHNKLQQMVDSFIIIIAQQHELNLSAETVNLPLLGFHDTDFSRKVPWTQFNPTNIRIAPFPTREYTDDQFQAIVKEVMGILYLLGFLYPVSRLISYSVFEKEQKIKEGLYMMGLNDSIFHLSWFVTYAFQFAISSAVITACTMDNIFKYSDKTLVFAYFFIFGLSAIMLSFFISTFFKRAKTAVAVGTLSFLGTFLPYYSVNDEGVSMILKVLASLLSPTAFALGSINFADYERAHVGLRWSNIWRESSGVNFSACLLMMILDTLLYCAIGLYFDKVLPREYGLRYPWNFIFKKDLWRKRSSSSKIKFTGKSSESEGNLLGRGIFNPALEAISLDMKQQELDVKYDTLSLSYRFFSKTFRCIQIRNLHKVYATKKGDCCAVNSLQLTLYENQILALLEREFSYSILGLSLEYILVIEGDKLSIGSSSLQCKLFKGTKMAHVECVKKIEKKIHYKYVVSLSETPPTNFGHNGAGKSTTISMLVGLLPPTSGDALIFGKNIVSDIDEIRKVLGVCPQHDILFPELTVREHLELFAILKGVDEDTLESVVINMADEVGLADKINTVVRSLSGGMKRKLSLGIALIGNSKVIILDEPTSGMDPYSMRLTWQLIKKIKKGRIILLTTHSMDEADELGDRIAIMANGSLKCCGRLIPFSYFSYILYTHLPRPKLPRWPPEEPPKVRELLLIELRRKVLIGREISLFLKHHYGVGYTLTLVKSAPTASIAGDIVYRYVPTATCISEVGTEISFRLPMASSSTFERMFREIESCMKKPVSSMEISGNCEKDSHGIESYGISVTTLEEVFLRVAGCDYDEDECFEENNRSLISEAVVSLPSNDRPSTKICYYKVCGNYKKILGFMSTMVGRACGLIFATVISFVNFISLQCCSCCLITTSTFWQHSKALIIKRAISARRDHKTIIFQLMIPAIFLFIGLLFLELKPHPDQISLTLSTSYFNPLLSGGGGGGPIPFNLSFPIAEEVAQNVKGGWIQRCNSSSYKFPNSEKALVDAVEAAGPALGPALLNMSEYLMSSFNESYQSRYGAIVMDDQNTDGSLGYTVLHNFSCQHAAPTFINLMNSAILRLATHNVNATIQTRNHPLPMTQSQHLQRHDLDAFSAAIIVNIAFSFIPASFAVSIVKEREVKAKHQQLISGVSVLSYWISTFIWDFVSFLFPASFAIVLFYIFVFNDNTCLLNTVIGLDQFVGGVSLIPTIIMLLEYGLAIASSTYCLTFFFFDHTVAQNVVLLVHFFSGLILMVISFIMGLLPSTISANSFLKNFFRISPGFCFADGLASLALLRQGMKDKTSDGVYDWNVTGASICYLAVESFIYFLLTLGLEIYPSLKLTPFKIKKWWGKINIFPHNTSYLEPLLESSPETFVTDLNEDVDVKTERNRVLSGSIDNAIIYLRNLRKVYSEEKNHGKKVAVDSLTFSVQEGECFGFLGTNGAGKTTTLSMLCGEESPSDGTAFIFGKDICSHPKAARKYIGYCPQFDALLEFLTVKEHLELYARIKSVPDYTIDNVVMEKLVEFDLLKHANKPSFSLSGGNKRKLSVAIAMIGDPPIVILDEPSTGMDPIAKRFMWDVISRISTRRGKTAVILTTHSMNEAQALCTRIGIMVGGQLRCIGSPQHLKTRFGNHLELEVKPTEVSSVDLQTLCQTIQEILFDVPSQPRSLLNDLEICIGGADSVTSGNTSIAEISLTSEMIGLIGRWLGNEERVKTLTCCTPVYDGASQEQLSEQLLRDGGIPLPVFSEWWLSKQKFSEIDSFILCSFRGAKCQGYNGLSIRYQLPCDEDFSLADVFGLLEASRDKLGIAEYSLSQSTLETIFNHFAANS

SEQ ID NO: 15124 - protein, 402 aa, Medicago truncatula
MEPLDDSDSKLERVDSDQTSTSSASGISSVFSTDDFRNGDISSISSGSGEIPTCTVNRVILAPPLIAMSNEADKNEPAAPEEVVVTAVTREKCVGMNNKGVSWGHTSVIGRRREMEDAVAVIPGFMSRTCDHVGGCTAPGSRSSGEISPIHFFGVYDGHGGAQVAKFCAKRMHNVIAEEWEQEIAGGAEWQKRWEAVFANGFERTDSEIESDEVAPEMVGSTASVVVLSGCQIITSNCGDSRVVLCRRTQTVPLTVDQKPDREDELLRIEGEGGKVINWNGARVFGVLAMSRAIGDRYLRPWIIPVPEVTFTARTDEDECLILASDGLWDVMTNEEVGEVARSILRRRRRSLSSTEEISPTQVVADSLTEIAIGRNSTDNVSIIVVDLKSKRKRVQRPPSIS

SEQ ID NO: 15125 - protein, 517 aa, Medicago truncatula
SNHKQTVAFKIRRSNHVRSQIIKNVEVIQSYARDTFEKVESQHKAGECEYRQLLASFLFPAQQINYKFTMDACAIKKTRNNFPHTCHFLTCPFFSFYRLFFFPPPLSFSLNHCSVMEPLDDSDSKLERVDSDQTSTSSASGISSVFSTDDFRNGDISSISSGSGEIPTCTVNRVILAPPLIAMSNEADKNEPAAPEEVVVTAVTREKCVGMNNKGVSWGHTSVIGRRREMEDAVAVIPGFMSRTCDHVGGCTAPGSRSSGEISPIHFFGVYDGHGGAQVAKFCAKRMHNVIAEEWEQEIAGGAEWQKRWEAVFANGFERTDSEIESDEVAPEMVGSTASVVVLSGCQIITSNCGDSRVVLCRRTQTVPLTVDQKPDREDELLRIEGEGGKVINWNGARVFGVLAMSRAIGDRYLRPWIIPVPEVTFTARTDEDECLILASDGLWDVMTNEEVGEVARSILRRRRRSLSSTEEISPTQVVADSLTEIAIGRNSTDNVSIIVVDLKSKRKRVQRPPSIS

SEQ ID NO: 15126 - protein, 832 aa, Glycine max
MASTANHCLQLAGATESTRRWRISISCKKKSDKLAFKETKEGFVDYDRGQHEVSTKISGLRKDDIAARYRLRVAGNRFQMDWTVSEVAELVLSLNLSDDDDVDGLLNRWVGRFARKNFPFLIKELTQRGSIEHCNRVFRWLKNQKNYRARNDIYNMMIRLHARHNRTDQARGLFFEMQEWRCKPDVETYNAIINAHGRAGQWRWAMNIMDDMLRAAIPPSRSTYNNLINACGSSGNWKEALNVCKKMTENGVGPDLVTHNIILSAFKSGAQYSKALSYFELMKGTHIRPDTTTLNIVIHCLVKLRQYDKAIEIFNSMREKKSECTPDVVTFTSIIHLYSVCGQVENCEAAFNMMIAEGLKPNIVSYNALIGAYAARGMDNEAHLFFNEIKQNGFRPDIVSYTSLLNAYGRSQKPHKARQIFDRMKRNKLKPNLVSYNALIDAYGSNGLLADAIKILREMEQEGIQPNVVSICTLLAACGRCSRKVKIDTVLTAAEMRGIKLNTVAYNAAIGSCMNVGEYDKAIGLYKSMRKKKIKTDSVTYTVLISGCCKMSKYGEALSFMEEIMHLKLPLSKEVYSSAICAYSKQGQIVEAESTFNLMKSSGCYPDVVTYTAMLDAYNAAENWEKAYALFEEMEASSIKLDTIACAALMRSFNKGGQPGRVLSLAESMREKEIPFSDTIFFEMVSACSILQDWRTAVDMIKYIEPSLPVISSGCLNQFLHSLGKSGKIETMLKLFFKMLASGADVNLNTYSILLKNLLSSGNWRKYLEVLQWMEDAGIHPSKEMYHDISSFSQKCCGNENAAVIRERLGMNIYVVLRIVFPYVHMHALSFF

SEQ ID NO: 15127 - protein, 843 aa, Lupinus angustifolius
KTEINIEFLKERLSSFSMSTTTLHSTYNLKLTDSTRPHITCKRKPNELTFKETQQGFVDYDNGHHDVSNKVTGILKDGIPARYRIRVAGNRFQKDWTVSEVVELVLNLDLRDDIDGLLNRWVGRFARKNFPYLIKELSQRGNIEHCNSVFEWMKKQKNYCARNDIYNMMIRLHARHNRVDQARGLFFEMQKWRCKPDVETYNAIINAHGRAGQWRWAKNIMEDMLRAAIAPSRSTYNNLINACGSSGNWKEALNICKKMTDNGVGPDLVTHNIVLSAFKSGAQYSKALSYFELMKGTHIRPDTTTHNIIIHCLVKLGQHDKAIDIFNSMREKKSECHPDVVTFTSIIHLYSVCGQVENCGAAFSMMLAEGLKPNIVSYNTLIGAYAARGMDKEAFSVFSEINQNGLRPDIVSYTSLLNAYGRSQKPQKSREVFEMIKRNKLKPNVVSYNALIDAYGSNGLLAEAIEILREMEQDGIYPNVVSICTLLAACGRCSKKVKIETVLSAAEMRGIKLNTFAYNSAIGSYMNVGEYDKAIGLYKSMRKKKIKPDSVTYTVLISGCCKMSKYGEALSFMEEMMQLELPLSKEVYSSIICAYSKQGQIVEAESTFNLMKSSGCYPDVVTYTAMLDAYNAAENWEKAYALYEEMEVNGIKLDTIACAALMRAFNEGGQSGRVLSLAKNMREKDIPFSDTIFFEMVSACSLLHDWRTAVDMIKHIEPSLPVISSGCLNLFLQFLGNSGKNETMLKLFYKMLASGAEVNFNTYSILLKNLLSSGNWRKYLEVLEWMEDAGIYPSNGMYRDLSSFSQRCCGEENAAIIKERLESLKRKSGNQVSTSQTESPILC

SEQ ID NO: 15128 - protein, 813 aa, Medicago truncatula
MATTTSPYCIQLSGVTESTRPPKSTTTRKKSSNEVAFKEKKDGFVDYDRGHHQVSTKISGLRKEDIPAHYRLRVAGNRFQKDWTVSEVVDSVLSLTLRDDIEGLLNRWIGRFARKNFPFLIRELTQRGSIEHCNLVFSWMKNQKNYCARTDIYNMMIRLHARHNRTDQARGLFFEMQKCRCKPDAETYNALINAHGRAGQWRWAMNIMDDMLRAAIPPSRSTYNNLINACGSSGNWKEALNVCKKMTDNGVGPDLVTHNIMLTAFKSGTQYSKALSYFELIKGTHIRPDTTTHNIIIHCLVKLKQYDKAVDIFNSMKEKKSECHPDVVTFTSMIHLYSVCGHIENCEAAFNMMLAEGLKPNIVSYNALLGAYAARGMENEALQVFNEIKQNGFRPDVVSYTSLLNAYGRSRKPQKAREIFKMIKRNNLKPNIVSYNALIDAYGSNGLLEDAIEILREMEQDKIHPNVVSICTLLAACGRCGQKVKIDTVLSAAEMRGIKLNTVAYNSAIGSYINVGEYDKAIDLYNSMRKKKIKSDSVTYTVLISGCCKMSKFGEALSFMEEMMHLKLPMSKEVYSSIICAYSKQGQIIEAESTFNLMKSLGCSPDVVTYTAMLDAYNAAEKWEKLYALFEEMEENDVKLDTIACAALMRAFNKGGQPGRVLSLAQSMREKDIPLSDTIFFEMVSACGLLHDWKTAVDMIKYMEPSLPVISSGCLNLFLNSLGKSGKIEIMLKLFFKMLASGAEVNFNTYSILLKNLLSSGNWRKYLEVLQWMEDAGIHPSNEMYRDISFSQKNCGVENAAVIKERLGMDTLF

SEQ ID NO: 15129 - protein, 170 aa, Glycine max
MRKKKIKTDSVTYTVLISGCCKMSKYGEALSFMEEMMHLKLPLSKEVYSSVICAYSKHGQIVEAESAFNLMKSSCVPDVVTYTTIVDAFNAAENLAKAYALFEEIEASGIKLDTIARAALMRSFNKGGQPGRVLSLAEITREKKFLSVIPYFLKWYLPVAYYKIGGQLLI

SEQ ID NO: 15130 - protein, 319 aa, Arachis hypogaea
MYHPLYLTLVGDGVLKQIPPSRSTYNNLINACGSSGNWKEALNVCKKMTDNGVGPDLVTHNIVLSAFKSGAQYSKALSYFELMKGTHIRPDTTTLNIIIHCLVKLQQYDKAIDIFNSMRRNKSDCRPDVVTFTSIIHLYSTCGQVENCVAAFNMMLAEGLKPNTISYNSLIGAYAARGMDKEALVVFNEIKQNGFRPDIVSYTSLLNAYGRSQKPQKAREIFAMIKKNRLKPNIVTYNALIDAYGSNGLLAEAIEILREMEQDGIYPNVVSICTLLAACGRCSQKVKIDTILSAAEMRGIKLNTVAYNSAIGAYMNVGK

SEQ ID NO: 15131 - protein, 122 aa, Brassica rapa
MAKSSFQLSNPLETRMNEATRIREKYPDRVPVIVEKAGQSDVPDIDKKKYLVPADLTVGQFVYVVRKRIKLGAEKAIFVFVKDTLPPTAALMSAIYEEHKDEDGFLYMTYSGENTFGSFIVA

SEQ ID NO: 15132 - protein, 468 aa, Brassica rapa
MALAINVSSSSSSAISTSSFPSSELKAPRIGSLRLSDRVNVSTASLSLSGKRSSSVKPLNVQSIAKESFVPSQAASVVASEVTEKLDVVEVEDFEELAKSLETASPLEIMDKALEKFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNGNANANVNGTSSTVADIFKSENVVSLSRQGIENLMKLENRKEAWIVVLYAPWCPFCQAMEGSFDELADKLGGSGVKVAKFRADGDQKEFAKRELQLGSFPTILVFPKNSSRPIKYPSEKRDVDSLTSFLNLVR

SEQ ID NO: 15133 - protein, 470 aa, Brassica napus
MALAINVSSSSSSAISTSSFPSSELKVSAPRIGSLRLSDRVNVSSASLSLSGKRSSSVKPLNVQSFTKESFVPSQAASVVASEVTEKLDVVEVEDLEELAKSLETASPLEIMDKALEKFGNDIAIAFSGAEDVALIEYAHLTGRPFRVFSLDTGRLNPETYRLFNTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNGNANANVNGTSSTVADIFKSENVVSLSRQGIENLMKLENRKEAWIVVLYAPWCPFCQAMEGSFDELADKLGGSGVKVAKFRADGDQKEFAKRELQLGSFPTILVFPKNSSRPIKYPSEKRDVDSLTSFLNLVR

SEQ ID NO: 15134 - protein, 465 aa, Eutrema parvulum
MALAIKVSSSSSAISSSSFPSSELKAPQIGSLRLSDRINVSSASLSLSGKRSSVKPLNVLSITKESMVTPQAAPMVASEVTEKLDVVEVEDFEELAKRLENASPLEIMDKALEKFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNGNATANVNGTSTVADIFKSENVVNLSRQGIENLMKLENRKEAWIAVLYAPWCPFCQAMEASFDELADKLNGSGVKVAKFRADGDQKEFAKRELQLGSFPTILVFPKNSSRPIKYPSEKRDVDSLTSFLSLVR

SEQ ID NO: 15135 - protein, 464 aa, Eutrema halophilum
MALAINVSLSSSGISSSSFPSSELKVSQIGSLRLSDRINVSAASLSFSGKRSSVKPLNVQSITKESMVSQAASMVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQIDPVFEGLDGGAGSLVKWNPVANVEGNDVWNFLRTMDVPVNTLHAAGYVSIGCEPCTRAVLPGQHEREGRWWWEDAKAKECGLHKGNIKENNNGNATANVNGTSTVADIFKSENVVNLSRQGIENLMKLENRKEAWIVVLYAPWCPFCQAMEASFDELADKLAGNGVKVAKFRADGDQKEFAKRDLQLGSFPTILVFSKNSSRPIKYPSEKRDVDSLTSFLNLVR

SEQ ID NO: 15136 - protein, 465 aa, Eutrema parvulum
MALAIKVSSSSSAISSSSFPSSELKAPQIGSLRLSDRINVSSASLSLSGKRSSVKPLNVLSITKESMVTPQAASMVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQIDPVFEGLDGGAGSLVKWNPVANVEGNDVWNFLRTMDVPVNTLHAAGYVSIGCEPCTRAVLPGQHEREGRWWWEDAKAKECGLHKGNIKENNNGNATANVNGTSTVADIFKSENVVNLSRQGIENLMKLENRKEAWIVVLYAPWCPFCQAMEASFDELADKLAGNGVKVAKFRADGDQKEFAKRELQLGSFPTILVFSKNSSRPIKYPSEKRDVDSLTSFLNLVR

SEQ ID NO: 15137 - protein, 468 aa, Brassica rapa
MALAINVSSSSSSISTSSFPSSDLKAPQIGSLRLSDRINVSSASLSLSGKRSSVKALNVQSITKESMVPPQAASMVASEIREKVDVIEVEDFEELAKKLETASPLEIMDKALENFGNDIAIAFSGAEDVALIEYAHLTGRPYRVFSLDTGRLNPETYRLFDTVEKHYGIRIEYMFPDAVEVQALVRSKGLFSFYEDGHQECCRIRKVRPLRRALKGLRAWITGQRKDQSPGTRSEIPVVQVDPVFEGLDGGAGSLVKWNPVANVEGNDVWSFLRTMDVPVNTLHAAGYVSIGCEPCTRAVLPGQHEREGRWWWEDAKAKECGLHKGNIKESSNGNNAAVNGNGTTSTVDDIFKSENVVSLSRQGIENLMKLENRKEAWIVVLYAPWCPFCQAMEASFDELADKLRGGDGVKVAKFRADGDQKEFAKSELQLGSFPTILVFPKNSSRPIKYPSEKRDVDSLTSFLNLVR

SEQ ID NO: 15138 - protein, 468 aa, Brassica napus
MALAINVSSSSSSISTSSFPSSDLKAPQIGWLRLSDRINVSSASLSLSGKRSSVKALNVQSITKESMVPPQAASMVASEIREKVDVIDVEDFEELAKKLETASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWSFLRTMDVPVNTLHAAGYVSIGCEPCTRAVLPGQHEREGRWWWEDAKAKECGLHKGNIKESSNGNNAAVNGNGTTSTVDDIFKSENVVSLSRQGIENLMKLENRKEAWIVVLYAPWCPFCQAMEASFDELADKLKGGDGVKVAKFRADGEQKEFAKSELQLGSFPTILVFPKNSSRPIKYPSEKRDVDSLTSFLNLVR

SEQ ID NO: 15139 - protein, 464 aa, Brassica napus
MALAINVSSSSSAISTSSFPSSDLKAPQIGSLRLSDRINVSSASLSVSGKRSSVKALNVQSITKESTVPPQAASMVASEIREKVDVIEVEDFEELAKKLETASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWSFLRTMDVPVNTLHAAGYVSIGCEPCTRAVLPGQHEREGRWWWEDAKAKECGLHKGNIKESNATVNVNGTTSTVDDIFRSENVVSLSRQGIENLMKLENRKEAWIVVLYAPWCPFCQAMEASFDELADKLKGGDGVKVAKFRADGDQKEFAKSELQLGSFPTILVFPKNSSRPIKYPSEKRDVDSLTSFLNLVR

SEQ ID NO: 15140 - protein, 463 aa, Brassica napus
MALAINVSSSSSSISTSSFPSSDLKAPQIGSLRLSDRINVSSASLSLSGKRSSVKALNVQSITKESMVPPQAASMVASEIREKVDVIEVEDFEELAKKLETASPLEIMDKALEKFGNDIAIAFSGAEDVAHLTGRPYRVFSLDTGRLNPETYRLFDTVEKHYGIRIEYMFPDAVEVQALVRSKGLFSFYEDGHQECCRIRKVRPLRRALKGLRAWITGQRKDQSPGTRSEIPVVQVDPVFEGLDGGAGSLVKWNPVANVEGNDVWSFLRTMDVPVNTLHAAGYVSIGCEPCTRAVLPGQHEREGRWWWEDAKAKECGLHKGNIKESSNGNNAAVNGNGTTSTVDDIFKSENVVSLSRQGIENLMKLENRKEAWIVVLYAPWCPFCQAMEASFDELADKLKGGDGVKVAKFRADGDQKEFAKSELQLGSFPTILVFPKNSSRPIKYPSEKRDVDSLTSFLNLVR

SEQ ID NO: 15141 - protein, 458 aa, Arabidopsis lyrata
MALAINVSSSSSSAISSSSFPSSDLKVPQIGSLRLLDRINVSAASLSLSGKRSSVKALNVQSITKESIVASELTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWNFLRTMDVPVNTLHAAGYVSIGCEPCTRAVLPGQHEREGRWWWEDAKAKECGLHKGNIKENTNGNATANVNGTSTVADIFNSENVVNLSRQGIENLMKLENRKEAWIVVLYAPWCPFCQAMEASFDELADKLGGNGVKVAKFRADGDQKDFAKKELQLGSFPTILVFPKNSSRPIKYPSEKRDVDSLTSFFNLVR

SEQ ID NO: 15142 - protein, 458 aa, Arabidopsis thaliana
MALAINVSSSSSSAISSSSFPSSDLKVTKIGSLRLLNRTNVSAASLSLSGKRSSVKALNVQSITKESIVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWNFLRTMDVPVNTLHAAGYVSIGCEPCTRAVLPGQHEREGRWWWEDAKAKECGLHKGNIKENTNGNATANVNGTASVADIFNSENVVNLSRQGIENLMKLENRKEAWIVVLYAPWCPFCQAMEASFDELADKLGGSGVKVAKFRADGDQKDFAKKELQLGSFPTILVFPKNSSRPIKYPSEKRDVDSLTSFLNLVR

SEQ ID NO: 15143 - protein, 455 aa, Brassica napus
ISTSSFPSSDLKAPQIGSLRLSDRINVSSASLSLSGKRSSVKALNVQSITKESMVPPQAASMVASKIREKVDVIDVEDFEELAKKLETASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKESSNGNNAAVNGNGTTSTVDDIFRSENVVSLSRQGIENLMKLENRKEAWIVVLYAPWCPFCQAMEASFDELADKLKGGDGVKVAKFRADGEQKEFAKSELQLGSFPTILVFPKNSSRPIKYPSEKRDVDSLTSFLNLVR

SEQ ID NO: 15144 - protein, 242 aa, Raphanus sativus
  misc_feature (235)..(236): Xaa can be any naturally occurring amino acid
  misc_feature (240)..(240): Xaa can be any naturally occurring amino acid
MALAINVSSSSSPISTSSFPSSDLKTPQIGSLRLSDRINVSSASMSLSSGKRSSVKSLNVQSITKEAMVASEVTTEKEVDVVEVEDFEELAKKLETASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKINRRERGRRSPSFXXIRCXKD

SEQ ID NO: 15145 - protein, 464 aa, Unknown
  Sequence found in Organisms: Eutrema halophilum, Eutrema parvulum
MAMAATVSSSSSSGITSFSRISSEPKVSQIGSLRLLDRVNVTPMSLNLSGKRSSVKPLNAEPKTKDSMIPLAATMVAETAEEVEVVEIEDFEELAKKLENASPLEIMDKALEKFGNDIAIAFSGAEDVALIEYAHLTGRPFRVFSLDTGRLNPETYRFFDAVEKHYGIRIEYMFPDSVEVQGLVRNKGLFSFYEDGHQECCRVRKVRPLRRALKGLRAWITGQRKDQSPGTRSEIPIVQVDPVFEGLDGGAGSLVKWNPVANVEGNDVWNFLMTMDVPVNTLHAAGYVSIGCEPCTRAVLPGQHEREGRWWWEDAKAKECGLHKGNIKDEAKGNVVNGESKSAVVEDIFKSESLVTLSRQGIENLMKLENRKEPWIVVLYAPWCPFCQAMEASYDELADKLAGSGVKVAKFRADGDQKEFAKQELQLGSFPTILVFPKNSSRPIKYPSEKRDVDSLASFLNLVR

SEQ ID NO: 15146 - protein, 465 aa, Arabidopsis lyrata
MAMSVNVSSSSSSGIINSGFSRSGASSEPKVSQIGSLRLFDRVHVAPVSLNLSGKRSSSVKPLNAEPKTKDSMIPLAATMVAEIAEEVEVVEIAELAKKLENASPLEIMDKALEKYGKDIAIAFSGAEDVALIEYAHLTGRPFRVFSLDTGRLNPETYRFFDAVEKHYGIRIEYMFPDSVEVQGLVRSKGLFSFYEDGHQECCRVRKVRPLRRALKGLKAWITGQRKDQSPGTRSEIPVVQVDPVFEGLDGGVGSLVKWNPVANVEGNDVWNFLRTMDVPVNTLHAAGYISIGCEPCTKAVLPGQHEREGRWWWEDAKAKECGLHKGNVKENTADANVNGESKSAVADIFKSENLVTLSRQGIENLMKLENRKEPWIVVLYAPWCPFCQAMEASYDELADKLAGSGIKVAKFRADGDQKDFAKQELQLGSFPTILVFPKNSSRPIKYPSEKRDVDSLTSFLNLVR

SEQ ID NO: 15147 - protein, 470 aa, Eutrema parvulum
MAATVSSSSSSRITSYGFSRSGISSESKVSQIGSLRLLDRVNVVTPMSLNLSGKRSSVKPLNAEPKSKDSMIPLAATMVAEIAEEVEVVEIEDFAELAKKLENASPLEIMDKALEKFGNDIAIAFSGAEDVALIEYAHLTGRPYRVFSLDTGRLNPETYRFFDAVEKHYGIRIEYMFPDSLEVQGLVRNKGLFSFYEDGHQECCRVRKVRPLRRALKGLKAWITGQRKDQSPGTRSEIPIVQVDPVFEGLDGGAGSLVKWNPVANVEGNDVWNFLRTMDVPVNTLHAAGYISIGCEPCTRAVLPGQHEREGRWWWEDAKAKECGLHKGNIKENGAADATTGNVNGEPKPVVADIFKSENLVTLSRQGIENLMKLENRREPWIVVLYAPWCPFCQAMEASYDDLADKLAASGIKVAKFRADGDQKEFAKQELQLGSFPTILVFPKNSSRPIKYPSEKRDVDSLTSFLNLVR

SEQ ID NO: 15148 - protein, 457 aa, Brassica napus
MAMAATVSSSGITSSAFSRSVISSEPKVSQIGSLKLLDRVSVTTPMSLKKRSSVKPLNAEPKRNDSMVPLAATMVAQVAEEVVEAEDFAELAKKLENASPLEIMDKALEMFGNDIAIAFSGAEDVALIEYAHLTGRPYRVFSLDTGRLNPETYRFFDAVEKHYGIRIEYMFPDSVEVQGLVRSKGLFSFYEDGHQECCRVRKVRPLRRALKGLRAWITGQRKDQSPGTRSEIPVVQVDPVFGGLDGGAGSLVKWNPVANVEGSDVWSFLRTMDVPVNTLHAAGYVSIGCEPCTRAVLPGQHEREGRWWWEDAKAKECGLHKGNIKENANVNGESKPVVEDIFKSENVVALSRQGIENLVKLENRKEPWIVVLYAPWCPFCQAMEASYDELADKLAGSGVKVAKFRADGEQKEFAKQELQLGSFPTILVFPKNSPRPIKYPSEKRDVDSLTSFLNLVR

SEQ ID NO: 15149 - protein, 457 aa, Brassica rapa
MAMAATVSSSGITSSAFSPSVISSEPKVSQIGSLKLLDRVSLTTPMSLKKRSSVKPLNAEPKRNDSMVPLAATMVAQVAEEVVETEDFAELAEKLENASPLEIMDKALEMFGNDIAIAFSGAEDVALIEYAHLTGRPYRVFSLDTGRLNPETYRFFDAVEKHYGIRIEYMFPDSVEVQGLVRSKGLFSFYEDGHQECCRVRKVRPLRRALKGLRGWITGQRKDQSPGTRSEIPVVQVDPVFEGLDGGAGSLVKWNPVANVEGSDVWSFLRTMDVPVNTLHAAGYVSIGCEPCTRAVLPGQHEREGRWWWEDAKAKECGLHKGNIKENANVNGESKPVVEDIFKSENVVALSRQGIENLVKLENRKEPWIVVLYAPWCPFCQAMEASYDEMADKLAGSGVKVAKFRADGEQKEFAKQELQLGSFPTILVFPKNSSRPIKYPSEKRDVDSLTSFLNLVR

SEQ ID NO: 15150 - protein, 460 aa, Brassica napus
MAMAATVSSSGITSCAFSRSVISSEPKVSQIGSLKLLDRVSVTTPMPLNLSGKRSSVKPLNAEPKRNDSMVPLAATMVAQVAEEVVETEDFAELAKKLENASPLQIMDKALEMFGNDIAIAFSGAEDVALIEYAHLTGRPYRVFSLDTGRLNPETYRFFDAVETHYGIRIEYMFPDSVEVQGLVRSKGLFSFYEDGHQECCRVRKVRPLRRALKGLRAWITGQRKDQSPGTRSEIPVVQVDPVFEGLDGGAGSLVKWNPVANVEGSHVWSFLRTMDVPVNTLHAAGYVSIGCEPCTRAVFPGQHEREGRWWWEDAKAKECGLHKGNIKENANVNGESKPIVEDIFKSENLVALSRQGIDNLVKLENRKEPWIVVLYAPWCPFCQAMEASYDELADKLAGSGVKVAKFRADGEQKEFAKQELQLGSFPTILVFPKNSTGPIKYPSEKRDVDSLTSFLNLVR

SEQ ID NO: 15151 - protein, 146 aa, Solanum tuberosum
MPMRPTGGLKQDWDPIVLHKPKMKAQDLKDPKVVNQALRAGAQVQTVKKFDGGLNKKAATAAVNVKKLDEAAEPAALEKVTVDVRQAIQKARIEKKMSQADLAKKINERTQVVAEYENGKAVPNQLVLGKMEKVLGVKLRGKIHKS

SEQ ID NO: 15152 - protein, 146 aa, Solanum phureja
MPMRPTGGLKQDWDPIVLPKPKMKAQDLKDPKVVNQALRAGAQVQTVKKFDGGLNKKAATAAVNVKKLDEAAEPAALEKVTVDVRQAIQKARIEKKMSQADLAKKINERTQVVAEYENGKAVPNQLVLGKMEKVLGVKLRGKIHKS

SEQ ID NO: 15153 - protein, 144 aa, Solanum melongena
MPMRPTGGFKQEWDPIVLQKPKTKAQDLRDPKAVNQALQTGAQVQTVKKFDGGLNKKPATAVNARKLDEAAEPAALEKVPVDVRQAIQKARIEKKMSQADLAKKINERTQVVAEYENGKAVPNQLVLGKMAKVLGVKLRGKNHK

SEQ ID NO: 15154 - protein, 146 aa, Nicotiana benthamiana
MPVRPTGGMKQEWEPVVLHKPKKAQDLRDPKVVNQALRTGAQVQTVKKFDAGLNKKATATSAVVNVRKLDEAAEPAALEKVPVEVRQAIQKARIEKKISQAELAKQINERPQVVAEYENGKAVPNQVVLAKMEKILGVKLRGKIHK

SEQ ID NO: 15155 - protein, 146 aa, Nicotiana tabacum
  misc_feature (24)..(24): Xaa can be any naturally occurring amino acid
MPVRPTGGMKQEWEPVVLHKPKKXQDLRDPKIVNQALRTGVQVQTVKKFDAGLNKKTTAASAAANVRKLDEAAEPAALEKVPVEVRQAIQKARIEKKMSQSDLAKQINERPQVVAEYENGKAVPNQTVLAKMEKILGVKLRGKIHK

SEQ ID NO: 15156 - protein, 421 aa, Nicotiana benthamiana
MPSLLQIFLPLFPFFFFISFSVSHGPFLPKAIILPVNKDLSTFQYVTQVYMGAHLVPTNLVVDLGGSFLWTNCGLTSVSSIQKLVPCNSLKCSMAKPNGCTNKICGVQSENPFTKVAATGELVEGMFAVEFIDELKTGSIASIHEFLFSCASTTLLQGLARCAKGMLGLGNSRIALPSQLSDTFGFQRKFALCLSSSNGAIISGESPYLSLLGQDVSRSMLYTPLISSKNGASEEYYINVKSIKINGKKLSLNTSLFTMDEEGVGGTKISTISPFTTMKTSIYKTFIEAYEKIAISMNLTKVVSIAPFELCFSTEGIDVTKVGPNVPIMDLVLQSEMVKWRIYGRNSMVKVSDEVMCLGYLDGGVNQKASIVIGGYQLENNLFEFNLGTSMLGFTSSLSTAETSCSDFMLHSISKDSAFDS

SEQ ID NO: 15157 - protein, 399 aa, Capsicum annuum
FFLISFCVSHGPFLPKAIILPVNKDPFTFQYVTQVYMGTHLAPIKLVVNLGGSFLWADCGLTSQKLVPCNSLKCSMTKPNGCTNKICGVQQENPFTKVATTGQLAEDNFAVEFIDELKTGSIASIHQFLFSCASTSLLQGLARGAKGMLGLGNSRIALPSQLSDAFGFQRKFALCLSDSNGAIISGESPYLSLLGHDVSRSMLYTPLISSKDGVQRVYINVKSIKISGKKLSLNISLFTMDEEGHGGTKISTISPFTTLKSSIYEKFVEAYERFGISMGLIKVEPVAPFGLCFSAKGVDLTKVGPNVPTIDLVLQSEMVKWRIYGRNSMVKVNDEVMCLGILDGGVNQKASIVIGGHQLEDNLLEFNLGISMLGFTSSLSMSETSCSDFMFSKDEAFDS

SEQ ID NO: 15158 - protein, 325 aa, Solanum phureja
MASFFCSTKFLLLLFFVSAIPIAFIIHLETSSPTTHVYHYHSTGWLRECSKWDDANRRFIVSFFEGGLGVIPVEADYSPGDVLQEIPVVKDADLTGNASLGFTIDRERNRVLVAVADVLGNRYSALAAYDLTSWNRVFLTKLSGPEDEKAFADDVVVDTEGNAYITDAKADKIWKVGANGELKYTIKNPIFTPKEWYNKLVGLNGIVYHPNGYLLVVHTFSGNLFKIEIAKGDEVKLVKIDNGSLKFGDGMELLSPTKLVVAGNPTRLVESSDDWESGTIVGKAKGAIHRLSTAATVKEGTVYLNHMIGLGYPRKKHVLVEAVFS

SEQ ID NO: 15159 - protein, 326 aa, Solanum tuberosum
VASFFCSTKFLLLLIFVSAIPIAFIIHLETSSPTTHVYHYHSTGWLRECSKWDDANRRFIVSFFEGGLGVIPVEADYSPGDVLQEIPVVKDADLTGNASLGFTIDRERNRVIVAVADVLGNRYSALAAYDLTSWNRIFLTKLSGPEDEKAFADDVVVDTEGNAYITDAKADKIWKVGANGELKYTIKNPIFTPKEWYNKLVGLNGIVYHPNGYLLVVHTFSGNLFKIEIAKGDEVKLVKIDNGSLKFGDGMELLSPTKLVVAGNPTRLVESSDDWESGTIVGKAKGAIHRLSTAATVKEGTVYLNHMIGLGYPRKKHVLVEAVFSA

SEQ ID NO: 15160 - protein, 326 aa, Solanum melongena
MASFFCSTNFFLLLFFLSAIPIAFIIHLETSAPKTHVYHYHSTGWLRECSKWDDVNRRFIVSFFEGGLGVIPVDADYSPGDVLQEIPVVKDADLIGNASLGFTIDRERNRVLVAIADVFGNRYSALAAYDLTSWNRIFLTKLNGPEDEKAFADDVVVDTEGNAYITDAKANKIWKVGANGELKYTIRNPIFTPKEWYNKLVGLNGIVYHPNGYLLVVHTFSGNLYKIEIAKGDEVKLVKINNGSLKFGDGMELLSPTKLVVAGNPTKLVESFDDWESGTIVGKATGAIHRLSTAATVKEGAVYINHMIGLGYPSKKHVLVEAVFFA

SEQ ID NO: 15161 - protein, 484 aa, Unknown
  Sequence found in Organisms: Solanum tuberosum, Solanum phureja
MPGPTMESEFPVEPQSLKKLSFKSLKRSLDLFSPLHGHFPLPDPESKKIRTSFKLNVEYGGIKGSAAEPSSNAKAGVQNQAQPASAPSNALALPGPENTRDERTGNELALGPSIPANGPTDVRFSGKSNAVVPSHGSSERNLSTAAIMERIPSRWPRPIWRAPWKNYRVISGHLGWVRSVAVDPSNTWFCTGSADRTIKIWDLASGRLKLTLTGHIEQVRGLAVSNKHTYMFSAGDDKLVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFSLPKGEFMHNMLSQQKTIVNAMAVNDEGVMVTGGDNGSMWFWDWKSGHNFQQSQTIVQPGSLDSEAGIYALTYDATGSRLISCEADKTIKMWKEDETATPETHPLHFKPPKDIRRF

SEQ ID NO: 15162 - protein, 483 aa, Nicotiana benthamiana
MPGPTTMESEVAVEPQSIKKLSFKSIKRSLDLFSPLHGHFPPPDPEGKKIRTSYKLNVEYGGIKSTAAHPVSNAKAAVQNQAQNAPSNALALPGPENTRDEGTGNELALGPSIPAKGPADVRFPGKGNAIVPSHGSSERNLSTAAIMERIPSKWPRPVWHAPWKNYRVISGHLGWVRSVAVDPSNTWFCTGSADRTIKIWDLASGRLKLTLTGHIEQVRGLAVSNKHTYMFSAGDDKLVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFNLPKGEFLHNMLSQQKTIVNAMAVNDDGVMATGGDNGSMWFWDWISGHNFQQSQTIVQPGSLDSEAGIYALTYDMTGSRLISCEADKTIKMWKEDETATPETHPLHFKPPKDIRRF

SEQ ID NO: 15163 - protein, 483 aa, Nicotiana benthamiana
MPGPTTMESEVVVEPQSIKKLSFKSLKRSLDLFSPLHGHFPPPDPESKKIRTSYKLNVEYGGIKSTTAQPVSNAKVAVQNQAQNAPSNALALPGPENTRDEVTGNELALGPSVPAKGPADVRFPGKSNAIVPSHSSSERNLSTAAIMERIPSKWPRPVWHAPWKNYRVISGHLGWVRSVAVDPSNTWFCTGSADRTIKIWDLASGRLKLTLTGHIEQVRGLAVSNKHTYMFSAGDDKQVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFNLPKGEFMHNMLSQQKTIVNAMAVNDDGVMATGGDNGSMWFWDWRSGHSFQQSQTIVQPGSLDSEAGIYALTYDMTGSRLISCEADKTIKMWKEDETATPETHPLHFKPPKDTRRF

SEQ ID NO: 15164 - protein, 486 aa, Amsonia hubrichtii
MPGSSMELELPVEPQSLKKLSFKSLKRALDLFSPIHGHCPPPDPESKKIRISHKLNLEYGGIKGTDSHSSSNAKSAAQSQAQQSSAPSNALALPGPENSRDQQKAVSLDLVIGPTVQLKSGTDTGFSGKSNAVVPAHGSSERNLSTAAIMERIPSRWPRPVWHAPWKNYRVISGHLGWVRSVAVDPSNNWFCTGSADRTIKIWDLASGRLKLTLTGHIEQVRGLAISNKHTYMFSAGDDKQVKCWDLEQNKVIRSYHGHLSGVYCLALHPTIDILLTGGRDSVCRVWDIRSKMQIHALSGHENTVCSVFTRPTDPQVVTGSHDTTIKFWDLRYGKTMATLTHHKKSVRAMAPHPKEECFASASADNIKKFNLPRGEFVHNMLSQQKTIINAMTVNEEGVLATAGDNGSLWFWDWKSGHNFQQAQTIVQPGSLESEAGIYALSYDVTGSRLITCEADKTIKMWKEDETATPETHPLHFKPPKDIRRF

SEQ ID NO: 15165 - protein, 486 aa, Tabernaemontana elegans
MPGPAMDPDLPVEPQSLKKLSFKSLKRALDLFSPVHGHFPPPDPESKKIRISHKLNLEYGGVKDAARQPSSSAKLAAQSQAQQSSAPSNALALPGPENSGDKQKAASCDLVIGPSLQPKMGTDSGFSGKSNAVVPAHGSSERNLSTAAIMERIPSKWPRPVWHPPWKNYRVISGHLGWVRSVAVDPSNTWFCTGSADRTIKIWDLASGRLKLTLTGHIEQIRGLAISSKHTYMFSAGDDKQVKCWDLEQNKVIRSYHGHLSGVYCLALHPTIDILLTGGRDSVCRVWDIRSKMQIHALSGHDNTVCSVFTRPTDPQVVTGSHDTTIKFWDLRHGKTMATLTHHKKSVRAMALHPKEECFASASADNIKRFNLPRGEFLHNMLSQQKTIINAMAVNEEGVLATAGDNGSMWFWDWNSGHNFQQAQTIVQPGSLDSEAGIYALSYDVSGSRLITCEADKTIKMWKEDETATPETHPLHFKPPKDIRRF

SEQ ID NO: 15166 - protein, 486 aa, Panax ginseng
MPGQTMEPELPVEPQSLKKLSFKSLKRALDLFSPLHAQFPPPDPEIKKIRMGHKLNLEYGGIRSTTAQPPNHANSAAQQALQASTPSNALALTGPESYRDPHKGGVHNELVLVPSIKPKGLGDASFAGKSTTIIPAHGSSDRNLSTAALMERIPSRWPRPVWRPPWKNYRVISGHLGWVRSVAFDPSNEWFCTGSADRTIKIWDVGSGRLRLTLTGHIEQVRGLAVSNKHTYMFSAGDDKQVKCWDLEQNKVIRSYHGHLSGVYCLALHPTIDILLTGGRDSVCRVWDIRSKMQIHALSGHDNTVCSVFTRPTDPQVVTGSHDTTIKFWDLRYGKTMATLTHHKKSVRAMAQHPSEDCFASASADNVKKFNLPRGEFLHNMLSQQKTIINAMAVNEEGVMVTGGDNGSMWFWDWKSGHNFQQSQSIVQPGSLDSEAGIYATSFDGTGTRLVTCEADKTIKMWKEDENATPETHPLNFKPPKEIRRF

SEQ ID NO: 15167 - protein, 256 aa, Actinidia deliciosa
  misc_feature (110)..(110): Xaa can be any naturally occurring amino acid
  misc_feature (128)..(128): Xaa can be any naturally occurring amino acid
  misc_feature (135)..(135): Xaa can be any naturally occurring amino acid
  misc_feature (231)..(231): Xaa can be any naturally occurring amino acid
MEPVEPQSLKKLSFKSLKRSLDFFSPLHSHFPPPDPDSKKIRISHKFNAEYGGIKSNSQPPANAKSVAQDQAQQASGTSNALALPGPENSKDPRNGGAQTNLIVGPTVQXKGLDVALSGKSTAVVSAXGSSERNXSTSAIMERIPSKWPRPVWHPPWKNYRVISGHLGWVRSIAFDPSNTWFCTGSADRTIKIWDVGSGRLKLTLTGHIEQVRGLAVSNKHHTCSLLAMTXKLNAGTLNRTRLSVLIMGILVEFIA

SEQ ID NO: 15168 - protein, 486 aa, Sesamum indicum
MPGATMDSELPVEPQSIKKLSFKSMKRALDLFSPIHGQFPPPDPESKKIRVSHKLNTEYGGVKSVATESSTHTASAKSQAEKASAPSNVLALPGPEQPNEMQKGGPQKDLVISSTAQPRGPSEVGVQGRSTAVIPAHGSSERNLSTSAIMERIPSRWPRPVWHPPWKNYRVISGHLGWVRSVAIDPSNSWFCTGSADRTIKIWDLASGRLKLTLTGHIDQIRGLAVSSKHTYMFSAGDDKLVKCWDLEQNKVIRSYHGHLSGVYSLALHPTIDILLTGGRDSVCRVWDIRSKMQIHALSGHDNTVCSIFTRPTDPQVITGSHDSTIKFWDLRYGKTMATLTHHKKSVRAMAPHPKEDCFVSASAENIKKFKLPTGEFMHNMLSQQKTIINSAAVNEEGVLATAGDNGSLWFWDWKSGHNFQQAQTIVQPGSLDSEAGIYAITYDLTGSRLITCEADKTIKMWKEDETATPETHPLHFKPPRDIRRF

SEQ ID NO: 15169 - protein, 487 aa, Arachis hypogaea
MTSATSSSEVEPVEPQSLKKLSFKSLKRALDLFSPTHSHLAPPDPHSKRIRTTHKVLVEYGGIKLSTTQAPRQANSAAQGQAQPGPSNALALPGPGDSKDPQKGGPQNALVVGPTMPSTASNDRGFTGKSTAVISASSGSSERNLSTAALMERMPSKWPRPDWHAPWKNYRVISGHLGWVRSVAVDPSNTWFCTGSADRTIKIWDLASGRLKLTLTGHIEQIRGLAVSSKHTYMFSAGDDKQVKCWDLEQNKVIRSYHGHLSGVYCLALHPTIDILLTGGRDSVCRVWDIRSKMQIHALSGHDNTVCSVFTRATDPQVVTGSHDSTIKMWDLRYGKTMLTLTNHKKSVRAMAQHPKEQAFASASADNIKKFSLPKGEFFHNMLSQQKTIINTMAVNEEGVMVTGGDNGSLWFWDWKSGHNFQQAQTIVQPGSLDSEAGIYACTYDVTGSRLITCEADKTIKMWKEDETATPETHPLNFRPPKDIRRF

SEQ ID NO: 15170 - protein, 477 aa, Glycine max
MEVEPVEPQSLKKLSFKSLKRALDLFSPIHGHLATPDAESKKIRTSHKVSVEYGGIKSTANQPPPRQVSSATQDPGSSNTLALPGPGDSKDSQKGGPQNALVVGPTIPSTTPNDTGFQNKSTAVVSASGSSERNLSTSALMERMPSKWPRPVWHAPWKNYRVISGHLGWVRSVAVDPSNTWFCTGSADRTIKIWDLASGVLKLTLTGHIEQVRGLAVSNRHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKMWDLRYGKTMSTLTNHKKSVRAMAQHPKEQAFASASADNIKKFTLPKGEFCHNMLSQQKTIINAMAVNEEGVMVTGGDNGSMWFWDWKSGHNFQQSQTIVQPGSLDSEAGIYACTYDLTGSRLITCEADKTIKMWKEDESATPETHPLNFRPPKDIRRF

SEQ ID NO: 15171 - protein, 476 aa, Glycine max
MEVEPVEPQSLKKLSFKSLKRALDLFSPIHGHLAPPDAESKKIRTSHKVSVEYGGIKSTANQPPHQVSSATQDPGPSNTLALPGPGDSKDSQKGGPQNALVVGPTMPSTTPNDTGFQSKSTAVVSASGSSERNLSTSALMERMPSKWPRPVWHAPWKNYRVISGHLGWVRSVAVDPSNTWFCTGSADRTIKIWDLASGVLKLTLTGHIEQVRGLAVSNRHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKMWDLRYGKTMSTLTNHKKSVRAMAQHPKEQAFASASADNIKKFNLPKGEFLHNMLSQQKTIINAMAVNEEGVMVTGGDNGSMWFWDWKSGHNFQQSQTIVQPGSLDSEAGIYACTYDLTGSRLITCEADKTIKMWKEDESATPETHPLNFRPPKDIRRF

SEQ ID NO: 15172 - protein, 478 aa, Panax ginseng
MESELPVEPQSLKKLSFKSLKRALDLFSPLHGQFPPPDPASMKIRLSHKLNAEYGGIRSTTAQPPNHANSAAQQVPQASTTLALTGSESSRDPQKRGAQNELAVVPSIQPKGLGETSFSGKSTTIIPAHGTSDRNLSTAALMERIPSRWPRPVWRPPWRNYRVISGHLGWVRSVAFDPSNEWFCTGSADRTIKIWDVGTGTLKLTLTGHIEQVRGLAVSTKHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKFWDLRYGKTMATLTHHKKSVRAMAQHPIEDCFASASADNIKKFSLPKGEFLHNMLSQQKTIINAMAVNEDGVMVTGGDNGSMWFWDWKSGHNFQQSQTIVQPGSLDSEAGIYATSFDLTGTRLVTCEADKTIKMWREDPNATPETHPLNYKPPKEIRRF

SEQ ID NO: 15173 - protein, 482 aa, Mimulus guttatus
MPGATMDSEIPVEPQSLKKLSFKSVKRALDLFSPTHGQFPPPDPESKKIRVNYKLNNEYGGVKNVSTEPSTQTGSAKNRSQLTSTPNNVLALPGPERSNDMQKGGSQISTTGQPSGSSNVGVQGRSTTIIPASGLPERNLSTSAIMERIPSRWPRPIWHAPWKNYRVISGHLGWVRSVALDPSNNWFCTGSADRTIKIWDLASGRLKLTLTGHIDQVRGLAVSKKHTYMFSAGDDKLVKCWDLEQNKAIRSYHGHLSGVYCLALHPTIDILCTGGRDSVCRVWDIRSKMQIFALTGHDNTVCSVFTRPTDPQIITGSHDSTIKFWDLRYGKAMATLTHHKKSVRAMAQHPKEDAFVSASAENIKKFKLPRGEFMHNMLSQQKTIINAAAVNEEGVMATAGDNGSLWFWDWKSGHNFQQSQTIVQPGSLDSEAGIYAITYDLTGSRLITCEADKTIKMWKEDETATPESHPVHFKPPKDIRRF

SEQ ID NO: 15174 - protein, 480 aa, Cajanus cajan
MEVEPVEPQSLKKLSFKSLKRALDLFSPIHGHLAPPDADSKKIRISHKVSVEYGGIKSTVNQPPRQVSSSTQDSAQQAGSSNTVALPAPGVSKDPQKGRPQNALVVGPTMPSTTPNDIGFQSKSTAIVSASGSSERNLSTSALMERMPSKWPRPVWHAPWKNYRVISGHLGWVRSVAVDPSNTWFCTGSADRTIKIWDLASGVLKLTLTGHIEQIRGLAISNKHTYMFSCGDDKQVKCWDLEQNKVIRSYHGHLSGVYCLALHPTIDILLTGGRDSVCRVWDIRSKMQIHALSGHDNTVCSVFTRPTDPQVVTGSHDTTIKMWDLRYGKTMLTLTNHKKSVRAMAPHPKEQSFASASADNIKKFNLPKGEFVHNMLSQQKTIINAMAVNEEGVMVTGGDNGSMWFWDWKSGHNFQQSQTIVQPGSLDSEAGIYALTYDVTGSRLISCEADKTIKMWKEDETATPETHPLNFRPPKDIRRF

SEQ ID NO: 15175 - protein, 576 aa, Solanum phureja
MATPLKNTNRLSLAMERTGQWVFSQEIPTDVIVEVGEANFNLHKFMLVAKSNYIRKLILDTKESDVSRINLSDIPGGPEMFEKAAKFCYGVNFEITVHNVAALRCAAEYLQMTDKYCDNNLASRTEDFLAQVALTSLSGALVVLKSCENLLPLAHDLNIIQRCVDIAGAKACVEANFPSRSPPNWWTEELTILDVAFFERIIVAMKARGAKALTIASAIITYTERSLRDLVRDHSGNNTRLMEPEDSDMRMHQRELLESIVTLLPAEKAAFPINFLCCLLRTAIFLRAASSCKNELEKRISAILEHVTVDDLLVLSFTYDGERLFDLESVRRIISGFMEKEKSVAVFKGGDFGDVCTTAMQRVAKTVDAYLGEIATFGDLSISKFNGIAILVPKGARKADDDLYRAVDIYLKAHPHLDEIEREKVCSVMDPLKLSHEARVHASQNKRLPVQIVLHALYFDQLKLRSGAADDTNNNMPEAMATRNQLQADVSLVKENEVLRTELLKMKMYIADIQKTTTSTQGTSKGGLKKTTFFSSVSKTLGKFNPFKHGSKDTSNIVDDAALDLTKPRRRRFSIS

SEQ ID NO: 15176 - protein, 579 aa, Solanum tuberosum
MATPLKNTNRLSLAMERTGQWVFSQEIPTDVIVEVGEANFNLHKFMLVAKSNYIRKLILDTKESDVSRINLSDIPGGPEMFEKAAKFCYGVNFEITVHNVAALRCAAEYLQMTDKYCDNNLASRTEDFLAQVALTSLSGALVVLKSCENLLPLAHDLNIIQRCVDIAGAKACVEANFPSRSPPNWWTEELTILDVAFFERIIVAMKARGAKALTIASAIITYTERSLRDLVRDHSGNNTRLMEPEDSDMRMHQRELLESIVTLLPAEKAAFPINFLCCLLRTAIFLRAASSCKNELEKRISAILEHVTVDDLLVLSFTYDGERLFDLESVRRIISGFMEKEKSVAVFKGGEFGDVCTTAMQRVAKTVDAYLGEIATFGDLSISKFNGIAILVPKGARKADDDLYRAVDIYLKAHPHLDEIEREKVCSVMDPLKLSHEARVHASQNKRLPVQIVLHALYFDQLKIRSGAADDTNNNMPEAMATRNQLQADVSLVKENEVLRTELLKMKMYIADIQKTTTSTQGTSASHKGSLKKTTFFSSVSKTLGKFNPFKHGSKDTSNIVDDAALDLTKPRRRRFSIS

SEQ ID NO: 15177 - protein, 579 aa, Nicotiana benthamiana
MAVPIKNTNRLSLAMERTGQWVFSQEIPTDVVVEVGEANFNLHKFMLVAKSNYIRKLILESKETEVTRINLSEIPGGPEMFEKSAKFCYGVNFEITVHNVAALRCAAEYLQMTDKYCDNNLASRTEDFLAQVALNSLSGALVVLKSCENLLPLAEDLNIVQRCVEIASAKACVEANFPSRSPPNWWTEEFTILDITFFERIIISMKTRGAKALTAASAIITYTERSLRDLVRDHSGNGTRLVEPEDSDIRMHQRQLLESIVKLLPSDKAAFPINFLCCLLRTAIFLRATSRVNSNSCKNELEKRISAILEHVTVDDLLVLSFTYDGERLFDLESVRRIISGFVEKEKTVAVFNGGDFGQQVCSTAMQRVAKTVDAYLGEIATFGDLTIAKFNGIAILVPKGARRVDDDLYRAVDIYLKAHPNLDEIEREKVCSVMDTLKLSYEARVHASQNKRLPVQIVLHALYFDQLRIRSGGDDTSNLPEAMATRNQLQADVSLVKENEALRTELLKMKMYISDIQKTSQGTTSAKPSLSRKPTFFSSVSKKLGKLNPFKHGSKDTSMIDDATVDLTKPRRRRFSIS

SEQ ID NO: 15178 - protein, 568 aa, Olea europaea
MATPIKNNSRLTLAMERTGQWVFSQDIPTDVIVEVGEANFSLHKFMLIAKSNYIRKLIIESKEADLARINLSDIPGGPEIFEKAAKFCYGVNFEITVHNVAALRCAAEYLQMTDMYCDNNLCSRTEDFLSQVALSSLSGAVVVLKSCEDLLPMAEDLKIVQKCVDVASAKACVEANFPSRSPPNWWTEELTILDVSFFEKIITSMKSRGAKALTIASAIITYAERSLRDLVRDHSGKGIKSLDSGESDIRIQQRELLESIVALLPPEKAAFPINFLCCLLRTAIFLRATNSCKQELEKRISVILEHVTVDDLLVLSFSYDGERLFDLESVRRIISGFVEKEKNVAVFNGGDFKEVCSTAMQRVAKTVDAYLGEIATYVDLSISKFNGIANLVPKGARKVDDDLYRAIDIYLKAHPNLDEIEREKVCSVMDPLKLSYEARVHASQNKRLPVQIVLHALYYDQLKLRSGTDEQNSNAMTTRNQLQADVSLVKENEALRTELLKMKMYVQDLQKNQGTSSKGSAKKPTFFSSMSKTLGKLNPFKHGSKDTSNMDDGMPDLTKPRRRRFSIS

SEQ ID NO: 15179 - protein, 563 aa, Sesamum indicum
MANRLSLAMERTGQWVFSQEIPTDVIVEVGEANFSLHKFMLVAKSNHIRKLILDSKEADLTRIDLSDIPGGPEIFEKAAKFCYGVNFEITVHNVAALRCAAEYLQMTDKYCDNNLAGRTEDFLSQVALTSLSGALVVLKSCEDLLPMAEDLKIVQRCVEIASAKACVEANFPSRSPPNWWTEELTILDITFFAKIIASMRSRGAKGLTLASAIITYTERSLRDLVRDHSGNGTRSTDSMDTDLRARQRELLESIVALLPLEKSAFPINFLCCLLRTAIFLRADTRCKNELEKRISMILEHVTVDDLLVLSFTYDGERLFDLESVRRIISGFVEKEKNVAVFNAGDFREVCSTGMLRVAKTVDAYLGEIATYGELSISKFNGIANLVPKTARKVDDDLYRAIDIYLKAHPNLDEIEREKVCSVMDPLKLSYEARVHASQNKRLPVQIVLHALYYDQLKLRSGADDHKTPDALTTRNQLQADTSLVKENEALRTELLKMKMYIQDIQKSQGTTSKGSAKKPTFFSSVSKTLGKLNPFKHGSKDTSNIDDGMVDLTKPRRRRFSIS

SEQ ID NO: 15180 - protein, 563 aa, Plantago ovata
NSGRLSLAMERTGQWVFSQEIPTDVNIQIGDAKISLHKFMLVAKSNRIRKMILDSKEGDVTRIDLSGIPGGAENFEKAAKFCYGVNFEITVHNVAALRCAAEYLQMTDTYCDNNLAGRTEDFLSQVALTSLPGAVVVLKSCQDLLPMAEDLNIVQRCVDIASAKACVEANFPSRAPTNWWTEELTILDVCFFEKIIVSMKSRGAKGLTLASAIITYTERSLRDLVRDHSGSGIRSTDIAESGTRTRQRELLESIVTLLPSEKSAFPINFLCCLLRTAIFLRAENKCKHELEKRIWAILEHVTVDDLLVLSYTYDGERLFDLESVRRIISGFVEKEKNVAVFNAGDLTEVCSTTMQRVAKTVDAYLGEIATYVELSISKFNGIANLVPKAARKVDDDLYRAVDIFLKAHPNLDEIEREKVCSVMDPLKLSYEARVHASQNKRLPVQIVLHALYYDQLKIRSGANDQKMPDAMATRNQLQADVSLVKENEALRTELLKMKMYITDIKKNQATTSKTSSRKPTFFSSMSKTLGKLNPFKHGSKDTLNLDDEAVDLTKPRRRRFSIS

SEQ ID NO: 15181 - protein, 573 aa, Coffea canephora
MASPLVNNSSRLSLAMERTGQWVFSQEIPTDVLVEVGKATFSLHKFMLVAKSNCIRKLILESKEADLTRIDLSDIPGGPEIFEKAAKFCYGVNFEITVHNVAALRCAAEYLQMTDKYCDNNLAGRTEDFLSQVALPSLSGAVVVLKSCEDLLPLAEDLRIVQRCVDVVSSKACVEANFPSRSPPNWWTEELSILDVKFFGKVITSMKSRGAKAFTIASALITYSEKSLRDLVRDHSGNGARTAVSDDSDLRTRQRELLESIVALLPPEKSSFPINFLCCLLRAAIFLGAASACKIELEKRISAILEHVTVDDLLVVSFTYDGERLFDLESVRRIISGFMEKEKSVAVFNAGDFREVSSTAMLRAAKTVDAYLGEIATFSELSISKFNGIAILVPKAARKVDDDVYRAVDIYLKAHPNLDEIEREKVCSVMDPLKLSYEARVHASQNKRLPVQIVLHALYYDQLKLRSGTEDQKMPNAITTRRQLQADTSLARENEELRTELLKMKMYIADLQKTQGPSTKATAASSRRPTFFSSMSKTLGKLNPFKHGSKDTSNIDDALVDISKPRRRRFSIS

SEQ ID NO: 15182 - protein, 504 aa, Triphysaria pusilla
MANRVSLAMERTGQWVFSQDIPTDVIVVVGEANFSLHKFMLVAKSNHIRKLILDSKEADLSRLNLSDIPGGPEIFEKAAKFCYGVNFEITVHNVAALRCAAEYLQMTDKYCENNLAGRTEDFLSQVALTTLSGALVVLKSCEDLLPMAEDLRIVQRCVEIASAKACVEANFPSRSPPNWWTEELTILDITFFSRIIASMKSRGAKGLTLASSIITYTERSLRDLVRDHSGNAIRTSDLDVIDRQRELLESIVTILPSEKSAFPINFLCCLLRTAIFLRADNRCKNELEKRISSILEHVTVDDLLVLSFTYDGERLFDLESVRRIISGFAEKEKNVSVFSAGDFKEVCSTAMQRVGKTVDAYLGEIATYVDLSISRFNGIANLVPKAARKADDDLYRAIDIFLKAHPNLDEIEREKVCSVMDPLKLSYEARVHASQNKRLPVQIVLHALYYDQLKIRSGVEEHKTPDAITTRSQLQADVTLVKENEALRTELLKMKMYVQEIQKT

SEQ ID NO: 15183 - protein, 572 aa, Vitis vinifera
MAASLKGNNRRSLAMERTGQWVFSQEIPTDVVVEVGEANFSLHKFMLVAKSNYIRKLIMESKEADLTNIDLSDIPGGPEIFEKAAKFCYGVNFEITVHNVAALRCAAEYLQMTDKYCDGNLSGRTEDFLKQVALTSLSGAVVVLKSCEDLLPKAEELKIVQRCVDVASTKACNEANFPSRSPPNWWTEELSILDIGFFEKIIAAMKLRGAKSLTVASALITYTERTLRDLVRDHTGNGIRSSDTEDSNLRSRQRELLEAIVVLLPSERAALPINFLCCLLRSAIFLKVAHTCKNELEKRISAILEHVTVDDLLVLSFTYDGERLFDLDSVRRIISGFVEKEKSVAVFNGGDFQEVCSTAMQRVAKTVDAYLGEIATHGELSICKFNGIANLVPKDARKVDDDLYRAIDIFLKAHPNLDEIEREKVCSVMDPLKLSYEARVHASQNKRLPVQIVLHALYYDQLKLRSGADDAHDAMSTRSHLQADVSLVRENEALRSELMKMKMYISDIQKNSSAGGGKGLGGGSKKPTFFSSMSKTLGKLNPFRHGSKDTSNIDEVTAVDVTKPRRRRFSIS

SEQ ID NO: 15184 - protein, 326 aa, Solanum phureja
MAISTSFCRPISSFNAISSPSLCYFKPFYHHLKLDPSFALVKCCSSHIGQSPEHMNGRQPDLSPIAPFGVTMTNNGTSKPSYRWRRVLLKVSGEALAGDQAQNIDPKITMAIAREVAAVTRLGIEVAIVVGGGNIFRGSSWAGSSGLERSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPDARLQDNLTYHDVISKELSVMDLTAITLCQENNIPVVVFNLNKTGNIAKAIKGERVGTLIGDTWNTEAVVS

SEQ ID NO: 15185 - protein, 320 aa, Solanum melongena
MAICTSFCGPISSFNAITWPSLCFFKPHLKLDPSLPVVKCCSSHIGQSPDHRQPELSPIAPFGVTMTNNGTSKPSYRWRRVLLKVSGEALAGDQTNNIDPKITMAIAREVAAVTRLGIEVAIVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPDARLQDNLTYHDVIAKELSVMDLTAITLCQENNIPVVVFNLNKTGNIAKAIKGERVGTLIGDTWNTEAAVF

SEQ ID NO: 15186 - protein, 328 aa, Nicotiana benthamiana
MAISTSFCRPISSFNAISSPSLCFFKPLHHHFKLDDSFHSLVVKCCSSHMDKSPDHLNGRKPELSPIASFGVTMTDNGTSTPSYRWRRVLLKVSGEALAGDQAQNIDPKITMAIAREVAAVTRLGIEVAIVVGGGNIFRGSSWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPRHNPDARLQDNLTYHDVISKELSVMDLTAITLCQENNIPVVVFNLNKPGNIAKAIKGERVGTLIGDTWNTEAAVS

SEQ ID NO: 15187 - protein, 333 aa, Capsicum annuum
MAISTFLSRPISSFNAITWPSLCFFKSMYHQFKLDHPSLGVKCCSSHIDQSPDHMNGRQPELAHIAPFGVTMTNNRTSKPSYRWRRVLLKVSGEALAGDQAQNIDPKITMAIATEVAAVTRLGIEVAIVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPDARLQDNLTYHDVISKELSVMDLTAITLCQENNIPVVVFNLNKPGNIAKAIRGERVGTLIGDTWNTEAAASKRAKSLF

SEQ ID NO: 15188 - protein, 112 aa, Solanum melongena
FGYTRKDVLLIGVGVTLLGVGLKSGLEFLGFDPLQAGNVVQLVLVLGLTVGWISTYIFRVSNKEMTYALQLRDYESKVVEKRLESLTEAELQVLLEQVEEEKTRLTSGEEVK

SEQ ID NO: 15189 - protein, 204 aa, Glycine max
MAYVPHGNANFNSLFLKFAISHVGISSLPFLHPGLKSCTVFNRGTLIRQCLNGKRNFSLSEKRFNCKFSKKDRFFIPRSSSSSNSSGSTDEPSNETEKTPFGYTRKDVLLIGLGVTLLGIGLKSGLEFVGVDSLQAGNVVQLVLVLGLTVGWISTYIFRVSNKEMTYAQQLRDYESKVMEKRLESLTEAELQALLEEVEEEKSR

SEQ ID NO: 15190 - protein, 124 aa, Ricinus communis
MNSLLHGNLNCNILCQNRAFSYVGISSPTVLHFKRGGLISRSLYRKNIFSFPRKASSSSVISNKVKFITPRCSSSSDSSSSKDGSPDQGKAYTFWIHQEGCFIDWTWSYCSWLWLEKWTGVCWS

SEQ ID NO: 15191 - protein, 207 aa, Epimedium sagittatum
MALDMLGISASAHGFASQTRQTNKLSTFLQTFAAHGNLPCHRSYPTKIFPRLRSSMKSRKKFSIIPSSSGPSSSDGGEAEDGGEAESKVSDQVKVPFGYSRKDVLLIGVGVTLIGVGLKSGLEFVGVDPLQAGNVVQLVLVLGLTVGWISTYIFRVSNKEMTYAQQLRDYESKVMEKRLEGLTEAELQVLLEQVEEEKQRLTGGEKI

SEQ ID NO: 15192 - protein, 193 aa, Fagopyrum esculentum
MILVLGNSRLLNHNLNASGCSSFKFKGTLPSQLAFPRQDGIDVSAFATKQSVCSSLKRLSLIPRCSSNDDNNASINQDKTPFGYTRKDVLLIGVGVTVVGVGLKSGLEFIGWDSLQAGNVVQLVIVLGLTVGWISTYMFRVSNKEMTYAQQLRDYESKVMEKRLESLTEAELAVLLEQVEEEKQRDSSSKQVG

SEQ ID NO: 15193 - protein, 200 aa, Lupinus angustifolius
MAYVIPHVNINCTFLYQKCAISYLGISALPFLQPRLKASTGFSRGTVIPQCFNGRRSFTLPGNRVRKVFKKDRFSIPRSTTSNSSGDSADETKKTPFGYTRKDVILIGVGVTLLGIGLKSGLEFAGVDPLQAGNVVQLVLVLGLTIGWISTYIFRVSNKEMTYAQQLRDYEGKVMEKRLESLTEAELQALLEEVEEEKRR

SEQ ID NO: 15194 - protein, 208 aa, Amsonia hubrichtii
MASVPCPEISNSILCKSRAISLVGLSSFPLQEPRSVEYFSRERVLSASLLRQGSSPFLRKRFYGFVPKQVTIIPRSNIFPNSGGSEDNSSKQEKTPFGYTRKDVLLIGLGVTVAGIGLKSGLEFLGVDPLQAGNVVQLVLVLGLTVGWISTYIFRVSNKEMTYAQQLRDYESKVMEKRLESLTEAELAALLEQVEEEKRRLASGEQAK

SEQ ID NO: 15195 - protein, 211 aa, Humulus lupulus
MATVFHGSTANSSMLCERGAISLMGISALPLLQTRVRVFDGLVKGKLITQNLYRNKKSSFQGRGYKSMRSKRVVFTVPRCSGSSDSNNSENDSSNKAKTPFGYNRKDVILIGIGVTALGVGLKSGLEFVGVDPLQAGNVVQLVLVLGLTIGWISTYIFRVSNKEMTYAQQLRDYESKVMEKRLEGLTEAELEALLEQVEEEKRLASGEQVK

SEQ ID NO: 15196 - protein, 85 aa, Cannabis sativa
MTFATFRFCLFQFSPELQVLSHFCLLNPSHPVFLYAHFRPNHRRHGMTYNIHTLKNIHFFRDSRRFLTHWTISQLTILSLTPTYA

SEQ ID NO: 15197 - protein, 211 aa, Catharanthus roseus
MASVPCSDISHSLLCKSKAISSVGLSYSPLQGSRPRSVECFNRERVISASVLKQGRSHFLSKGFYGLVSKKVATIARSNVSSNSGGNEDNSSKQEKTPFGYTRKDVILIGVGVTLAGIGLKSGLEFLGVDPLQAGNVVQLVLVLGLTVGWISTYIFRVSNKDMTYAQQLRDYESKVMEKRLESLTEAELAALLEQVEEEKRGLAGGGEQSK

SEQ ID NO: 15198 - protein, 204 aa, Chelidonium majus
LVSIDSYSGHGFSLETTQKINFSRPSSSLLNTFPRKVTPQGSYSTKSFSFPRRCVDNINSRTKFSVVPRSGGSSSSNGSENDSKASDQTKVPFGYSRKDVLLIGVGVTLLGIGLKSGLEYAGVDPLQAGNVVQLVLVLGLTVGWISTYIFRVSNKEMTYAQQLRDYEAKVMEKRLEGLTEAELQVLLEQVEEEKQRSASGEKVN

SEQ ID NO: 15199 - protein, 209 aa, Lippia dulcis
MAAMPMADLCSNSMFSKYRSIPLTGLSAFPWQEARTRPAQCSFKERITSREFITQGACRKRNFSSISKKSLSIIPRCSDSPNASGDKDKPSNKGKTPFGYTRKDVLLIGVGVTAAGYGLKSGLEFVGVDPLQAGNVVQLVLVLGLTVGWISTYIFRVSNKEMTYAQQLRDYEVKVMEKRLESLTEAEIQALLEQVEEEKQRLASGEQVN

SEQ ID NO: 15200 - protein, 202 aa, Trigonella foenum-graecum
MMACAKSTICYSALPFFQRTGLPPASSSSSFNNTGTFIPQCFSGNSSFILTWKSFSCSSSKFSNNDIFSIPTRRTRTTTITSSNSTNNDTSNQAKKATFGYSRKDVILIGLGVTFLGIALKSGLEFTGVDPLQAGNVVQLVLVLGLTLGWISTYIFRVSNKEMTYAQQLRDYESKVMEKRLESLTEAELQVLLQEVEEEKSR

SEQ ID NO: 15201 - protein, 202 aa, Trifolium pratense
  misc_feature (16)..(16): Xaa can be any naturally occurring amino acid
LSSGWQHMLLVLFPLXALPFFQQRRIPLLQPPPSFSSPFNNTGGRGGGGGGTLIPQCLNGKKRFSLKFSNKHRFTSIHTRSTNDDEIDTSNKQTKKAPFGYSRKDVILIGLGVTFLGIALKSGLEFAGVDPLQAGNVVQLVLVLGLTVGWISTYIFRVSNKEMTYAQQLRDYESKVMEKRLESLTEAELQVLLQEVEEEKSR

SEQ ID NO: 15202 - protein, 205 aa, Glycine max
MAYVPHGNANCNSLFQKFANSHVGISALPFLQPGLKSCTVFNRGTLIPLCLNGKRSFALSEKGFNCKFSKRERFSIPRSSSSSNSSGSTDETSKETNVKTPFGYTRKDVLLIGLGVTLLGIGLKSGLEFVGVDSLQAGNVVQLVLVLGLTVGWISTYIFRVSNKEMTYAQQLRDYESKVMEKRLESLTEAELQALLEEVEEEKSR

SEQ ID NO: 15203 - protein, 186 aa, Coffea canephora
MASVPCSDISNSVLCKSRAISLVGLSSFPLSEPKAGGLPYLSRDRVISQGILRRGTLPYIRRGLHGFVTKKVTTIPRSNISSNSSDGSGDDSSDQDKTPFGYTRKDVLLIGLGVTLFGIGLKSGLEFFGVDPLQAGNVVQLVLVLGLTVGWISTYIFRVSNKEMTYAQQLRDYESKVMEKRLESLT

SEQ ID NO: 15204 - protein, 200 aa, Ipomoea nil
MASTTYAPAYSSLICTTRVVSLMGLPLFPLMKPENGRSRSPGLLRAGTSTVFKSGSYSASNKSKTLFPPRCSLDSSGSKDESSNKDKTPFGYTRKDVLLIGLGVTAAGYGLKGGLEFLGVDSLQAGNVVQLVLVLGLTVGWISTYIFRVSNKEMTYAQQLRDYESKVMEKRLESLTEAELQVLLEQVEEEKQSLAKGDQV

SEQ ID NO: 15205 - protein, 212 aa, Sesamum indicum
MATTPCIDLCNNSIFCKNRPISIMGSSAFPLRQSRKRRAQCFLKERNYSRKFITQGAIPFLKRTSFSSISKTSVSTITRCSNSPNLGGDRDEPSNQEKTPFGYTRKDVLLIGLGVTVAGIGLESGLEYLGVDPLQAGNVVQLVLVLGLTVGWISTYIFRVSNKEMTYAQQLRDYEVKVMEKRLESLTEAEIEALLEQVEEEKRRLAGGEQMK

SEQ ID NO: 15206 - protein, 204 aa, Vigna unguiculata
MAYVAYGNANCNSLFQKFARIHVGISALPFFQLGVNSCTVFNRGTVIPLCLNRKRSFALSENRFNCKLPKKERFSILTSRNSSNPSGSTDENSKETEKTPFGYTRKDVLLIGLGITLLGIGLKSGLEFAGVDSLQAGNVVQLVLVLGLTVGWIFTYVFRVSNKEMTYAQQLRDYESKVMEKRLESLTEAELQALLEEVEEEKRR

SEQ ID NO: 15207 - protein, 62 aa, Vaccinium corymbosum
NHSNHSPHSRGSSVHSNSHYPFPSALQTHILSFKFQNQGDRRKKRQLEWLICSTQILVPMFY

SEQ ID NO: 15208 - protein, 129 aa, Manihot esculenta
MKMVPLVKARHQTPFGYTRKDVLLIGVGVTVLGIGLKSGLEFAGVDSLQAGNVVQLVLVLGLTVGWISTYIFRVSNKEMTYAQQLRDYENKVMQKRLEGLTEAELEALLEQVEEEKKRLANVLLSVSFI

SEQ ID NO: 15209 - protein, 95 aa, Prunus mume
MASLPHGNPTSCSLVCERGPISFVGISALPSIQLRARAFDGLVRGRVITHSLYRKETSLFCEKRSNSINRIMTIPRSSSSDSNGTEDDSSDQAKA

SEQ ID NO: 15210 - protein, 202 aa, Theobroma cacao
MSSPLHGHPTVSPTSFLGVSAFQFLQPPTRSAAVSFLRGTAIAQILYKKGTSLYLQNRLNNSRSKKLISVAPRCSRSSNSNESKDQSKTPFGYTRKDVLLIGVGVTVAGVGLKSGLEFAGVDPLQAGNVVQLVLVLGLTVGWISTYIFRVSNKEMTYAQQLRDYEDKVMQKRLEGLTEAELEALLEQVDEEKRSQASGEQVN

SEQ ID NO: 15211 - protein, 201 aa, Gossypium raimondii
MPSLLHVHPNKPISFLGISAFPLLQPSTKSTTASFIRGTAYPQILHRKEASLFLQNELNNTRSKKLVSFAPRCSGSTNSSDSKDQTKTPFGYTRKDVLLIGLGVTVAGVGLKSGLEFVGVDPLQAGNVVQLVMVLGLTVGWISTYIFRVSNKEMTYAQQLRDYEVKVMEKRLEGLTEAELEALLEQVEEEKQRQASGEQVN

SEQ ID NO: 15212 - protein, 210 aa, Vitis vinifera
MASLPLKSPNCSIFCERGSISIMGVSALPLLQQRVRAVGGLMRGSIISQSAYTKETSTFPRKGSNSMIPKKLVFTPRSSGSSNSDGSKDDSTNQDKVPFGYNRKDVLLIGVGVTVLGIGLKSGLEFVGVDPLQAGNVVQLVLVLGLTIGWISTYIFRVSNKEMTYAQQLRDYENKVMQKRLEGLTEAELEVLLEQVEEEKRRLASGEQVN

SEQ ID NO: 15213 - protein, 860 aa, Theobroma cacao
MAKASKDISGIEICRGGSNVTHLLFADDCMLFGKVKSRNTLGVEKEMGCQMLGIKNEQWEGFYLGMPLISGGSKRQIFSYVKARVTKRVLNWKNKFLSAAGRETLIKAVAQAVPNYVMSCFKLPKAICKYIDSVIARFWWNGDDSKRKQPTLAYKILKARYFPRVHFMDAPVGSNPSYLWRSIKESQQIIKKGLVWRVGNGNDIQVLEDSWIPYETPRVAMAYEENVSNSMMVSELIDARCGKWDEAKVKLCFPLYESNLILSIPLSVRLSVDRQVRVVSKHGQYTVKFGYRLISSLLDDSEPGCSSDSFDGFWKEVWKLSIPRKIIFFMWKALKGALPTKKALSHRKINVDNICVFCQEDEETDFHILCYCQFARATWLSSKWGFRDTGAHSTSVFDWIFQVSCNLGPKDVGEIACILWAIWKARNLRIFGNQIMNPVQVLKLGLDMNNQYHMAMEVSATENRVLERENRGFRSRGLTLHSDAAMDQVDGTTRVGAGFIIRRLNGGFFCAVGRKIQYCASVEEVELRALVWALSYCVKEQIMLADVFLDNQVVTGWIKKQQFTGALEHLIEDCTILMERINCQAIDFCSRETNRTAHSIAQIAKRMMDEMIEWKDSSHLPVLIQEAVDNDRVLFLRHEGKRTLRRCLLLCMDTQLSVPLLFWVFRLFSSCNRQHDQLLFLSYGVISSVVMSHSYAGTAIAQILYKKGTSLYLQNRLNNSRSKKLISVAPRCSRSSNSNESKDQSKTPFGYTRKDVLLIGVGVTVAGVGLKSGLEFAGVDPLQAGNVVQLVLVLGLTVGWISTYIFRVSNKEMTYAQQLRDYEDKVMQKRLEGLTEAELEALLEQVDEEKRSQASGEQVN

SEQ ID NO: 15214 - protein, 210 aa, Castanea mollissima
MASLPHGNMNCSILCKREAVSFVGLPAFPFLRPRARAFEGLVRGRLNRSLYKKETSLFLGKGSNHMLSKKLIFSIPRSSTASNSSGNGNNSSDQSKKPFGYTRKDVLLIGVGVTVIGVGLKTGLEFVGVDPLQAGNVVQLVLVLGLTVGWISTYIFRVSNKEMTYAQQLRDYENKVMEKRLEGLTEAELEALLEQVEEEKRRLASGDQVN

SEQ ID NO: 15215 - protein, 243 aa, Gossypium hirsutum
MEPLKLNDMPPSSEILDTLEFRRVVCKGVFDYERSIYIGPRSRSISGVTENGYYVITPLMPFPDNADSVQSPVLVNRGWVPRSWRDKSFEVSQDREKSSSTDVVPVQQNERSWWGMFQSKKQKAVEAQAPAITYVEVIGVVRGSEKPSVFVPPNDPNSGQWFYVDVPAIAVACGLPKDTLLIEDINENVNPSNPYPVPKDINALIRSSVMPQDHLNYTLTWYSLSAAVTFMAFKRLKPKNSRR

SEQ ID NO: 15216 - protein, 206 aa, Eucalyptus grandis
MALLLPLRGSWTAAVLSRDGPVSPADASAPPSLRRDARAPNDLFGGRASVRSFYMERHSFPSRSRLDRMMPKRTRFTSPRSGGSSDSSNVSEGSSDQGKAPFGYSRKDVLLIGLGVTVLGVGLKSGLELAGVDPLQAGNVVQLVLVLGLTVGWISTYIFRVSNKEMTYAQQLRDYENKVMEKRIESLTEAELEALLEQVEEEKRRA

SEQ ID NO: 15217 - protein, 201 aa, Gossypium raimondii
MPSLLHVHPNKPIPFLGISAFPLLLPSTKSTTASFIRGTADPQILHRKEASLFLQNELNNTRSKKLVSFAPRCSGSTNSSDSKDQTKTPFGYTRKDVLLIGLGVTVAGVGLKSGLEFVGVDPLQAGNVVQLVMVLGLTVGWISTYIFRVSNKEMTYAQQLRDYEVKVMEKRLEGLTEAELEALLEQVEEEKQRQASGEQVN

SEQ ID NO: 15218 - protein, 210 aa, Vitis vinifera
MASLPLKSPNCSIFCERGSISIMGVSALPSLQQRVRAVGGLMRGTIISQSAYTKETSTFPRKGSNSMIPKKLVFTPRSSGSSNSDGSKDDSTNQDKVPFGYNRKDVLLIGVGVTVLGIGLKSGLEFVGVDPLQAGNVVQLVLVLGLTIGWISTYIFRVSNKEMTYAQQLRDYENKVMQKRLEGLTEAELEVLLEQVEEEKRRLASGEQVN

SEQ ID NO: 15219 - protein, 194 aa, Heritiera littoralis
MPSILPISFLGISAFPSLQPPIRSTTALMRGTAVSQILYDKRTSLFLQNSLNNTRSKKLISIAPRCSGSSESSDSKDQTKTPFGYTRKDVLLIGLGVTLAGVGLKSGLEFAGVDPLQAGNVVQLVMVLGLTVGWISTYIFRVSNKEMTYAQQLRDYEAKVMQKRLEGLTEAELEALLEQVEEEKQRQASGEQVN

SEQ ID NO: 15220 - protein, 211 aa, Tabernaemontana elegans
MASVPCSDIGNSILCKTRAISLVGLCSFPLQEPRARSVEYFARERVISASPLRQGSSAFLRKGFYGLGSKKVQTTIPRGNISSNSGDSEDNSSEKEKTPFGYTRKDVLLIGLGVTIAGIGLKSGLEFLGVDSLQAGNVVQLVLVLGLTVGWISTYIFRVSNKEMTYAQQLRDYESKVMEKRLESLTEAELAALLEQVEEEKRRTASGKQAK

SEQ ID NO: 15221 - protein, 284 aa, Solanum melongena
MGSGHIFFDPSSCHGNMLFLGNGDPIFRGPRSTMMKMEDSSKRRPFFSSPEDLYDEEYYDEQSPEKKRRLTPEQVHLLEKSFETENKLEPERKTQLAKKLGLQPRQVAVWFQNRRARWKTKQLERDYDQLKSSYDSLLADFDSIRKDNDKLKSEVVSLMEKLQGKVVGAAGESEKTEALEVDAMTTLQVKVKAEDRLSSGSGGSAVVDEHSPQLVDSGDSYFHTDHEEYPGPGGCNIPPPVDGLQSEEDDGSDDGSCHGYFSNVFVAAEEQHHEGEEPLGWFWS

SEQ ID NO: 15222 - protein, 16 aa, Zea mays
MEKVWESGRRMSRSIG

SEQ ID NO: 15223 - protein, 16 aa, Sorghum bicolor
MEKVWESGRRMSRSIS

SEQ ID NO: 15224 - protein, 325 aa, Zea mays
MEVVAAAKQKAKKHIHLFYCSECEELALKVAASSDVIELQSINWRSFDDGFPNLFINKAHDIRGQHVAFLASFSSPAVIFEQVSVIFALPKLFIASFTLVLPFFPTGSFERVEEEGDVATAFTLAHILSMIPKSRGGPTSVVIYDIHALQERFYFGDDVLPCFETGIPLLLQRLRQLPDAENITIAFPDDGAWKRFHKLLQHFPMIVCNKVREGDKRIVRIKEGNPEGRHVVIVDDLVQSGGTLRECQKVLASHGASKVSAYVTHAVFPKQSYENFMASNSAGPGDQLAYFWITDSCPHTIKAIGQRPPFEVLSLAGSIADALQI

SEQ ID NO: 15225 - protein, 328 aa, Setaria italica
MEVATAAAAAKQKPKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKMLQHFPMIVCNKVREGDKRIVRIKEGNPEGRHVVIVDDLVQSGGTLRECQKALASHGAAKVSAYVTHAVFPKQSYERFMTSNSAGPGDQFAYFWITDSCPHTVKAIGQRPPFEVLSLAGSIADALQI

SEQ ID NO: 15226 - protein, 444 aa, Sorghum bicolor
MPIRLGVAYGIIARAFGPSRPSIKNREHSHNLFPHFVRLAVFSHRGPLFVSLARRGWGLGFRLPKAKNQGEIFAAAARLDKSRHQLFRQSRVHPSPRRSFWFPCPRRLRNPPMEVVAAAAAAAKQKTKKHEKHIHLFYCSECEELALKVAASSDAIELQSINWRSFDDGFPNLFINKAHDIRGQHVAFLASFSSPAVIFEQISVIFALPKLFISSFTLVLPFFPTGSFERVEEEGDVATAFTLARILSMIPKSRGGPTSVVIYDIHALQERFYFGDDVLPCFETGIPLLLQRLRQLPDAKNITIAFPDDGAWKRFHKLLQHFPMIVCNKVREGDKRIVRIKEGNPEGRHVVIVDDLVQSGGTLRECQKVLASQGAAKVSAYVTHAVFPKRSYERFMASNSVGPGDQFAYFWITDSCPHTVKAIGQRPPFEVLSLAGSIADALQI

SEQ ID NO: 15227 - protein, 326 aa, Brachypodium distachyon
MEVAAPAPKHKVKKQINLFYCAECEELALKVAASSDAIQLQSINWRNFPDGFPNLFINNAHDIRGQHVAFLASFSSPAVIFEQISVIFALPKLFIASFTLVLPFFPTGSFERVEEEGDVATAFTLARVLSMIPKSRGGPTSVVIYDIHALQERFYFGDDVLPCFETGIPLLLQRLRQLPDAENITIAFPDDGAWKRFHKLLVNFPMVVCAKVREGDKRIVRIKEGNPEGRHVVIVDDLVQSGGTLRECQKVLAAHGAAKVSAYVTHAVFPNQSYERFMTANSAGPGDQFAYFWITDSCPQTVKAISRHSPFEVLSLAGSIADALQI

SEQ ID NO: 15228 - protein, 302 aa, Cenchrus ciliaris
EELALKIAASSDAIELQSINWRNFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKMLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPQTVKAIGQSSPFEVLSLAGSIADALQI

SEQ ID NO: 15229 - protein, 367 aa, Brassica juncea
MASALNAAVSLTSPKSSALPATSCAIAPERIRFGKGAFYYKSNNVVTSCRRLVSVRAEVTTDTPPVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTFVYMCGLKGMEKGIDDIMVSLAANDGIDWFDYKKQLKKAEQWNVEVY

SEQ ID NO: 15230 - protein, 741 aa, Hordeum vulgare
MASRLLRLHHQLRRRRHHGTSPVPCRLLSSSSATEPPPPPQTAEKVLVANRGEIACRVMRTARRLGIATVAVYSDADRAALHVRAADEAVRLGPPPARESYLNAAAIVDAALRTGAKAIHPGYGFLSESADFAQLCESEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRTHIGEAAVSAAKAVGYYSAGTVEFIVDTLSGEFYFMEMNTRLQVEHPVTEMVVGQDLVEWQIRVANGERLPLSQEQVPLNGHAFEARIYAENVPRGFLPATGTLHHYQPVLSSPTVRVETGVEEGDAVSMHYDPMIAKLVVWGESRNAALVKLKNCLSNFQIAGLPTNVAFLQELAGHNAFERGLVDTHFIERYKDDFQSTSAKASGEAHDAAKLGAILAAACICKKDHITSEESLRDKTLSVWYTRPPFRMHHSAKRLMEFELDEELEELSDELLKLLVTYKSDGGYFIETEDGSSPGFDVKVDGRSENDFRVEVGGVQTDVTLAFYSKDNSKHIHIWHGKHHHHYRQTMRAEHLLDDSSQPRQASEGRSHPKGSVLAPMAGLVVKVLLKDGVHVEDGQPVMVIEAMKMEHVVKAPRAGYIEGLKATAGQQVFDSSVLFTVKDKSTN

SEQ ID NO: 15231 - protein, 741 aa, Triticum aestivum
MASRLLRLHHQLRRRRHHGTSPVPCRLLSSSSAPEPPLPSPTVEKVLVANRGEIACRVMRTARRLGIATVAVYSDADRAALHVRAADEAVRLGPPPARESYLNAAAIVDAALRTGAKAIHPGYGFLSESADFAQLCESEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRAHIGEAAVSAAKAVGYYSAGTVEFIVDTLSGEFYFMEMNTRLQVEHPVTEMIVGQDLVEWQIRVANGECLPLSQEQVPLNGHAFEARIYAENVPRGFLPATGTLHHYRPVLSSPTVRVETGVEEGDAVSMHYDPMIAKLVVWGESRNAALVKLKNCLSNFQIAGLPTNVAFLQELAGHNAFERGLVDTHFIERYKDDFQSTSAKASGEAHDAAKLGAILAAACICKKDHISSEESLRDKTLSVWYTRPPFRMHHSAKRLMEFELDEELEGLSDELLKLLVTYGSDGGYFIETEDGSSPGFDVKVDGRSEHDFRVEVGGVQTDVTLAFYSKDNSKHIHIWHGKHHHHYRQTMRAEHLLDDSSQPSQASEGRSHPKGSVLAPMAGLVVKVLLKDGVHVENGQPVMVIEAMKMEHVVKAPRAGYIEGLKATAGQQVFDSSVLFTVKDKSTS

SEQ ID NO: 15232 - protein, 738 aa, Triticum aestivum
MASRLLRLHHHLRRRRHHCTSPVPCRLLSSSDEPPRSQTVEKVLVANRGEIACRVMRTARRLGIATVAVYSDADRAALHVRAADEAVRLGPPPARESYLNADAIVDAALRTGAKAIHPGYGFLSESADFAQLCEAEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRTHIGEAAVSAAKAVGYYSAGTVEFIVDTLSGEFYFMEMNTRLQVEHPVTEMIVGQDLVEWQIRVANGERLPLSQEQVPLNGHAFEARIYAENVPRGFLPATGTLHHYRPVLSSPTVRVETGVEEGDAVSMHYDPMIAKLVVWGESRNAALVKLKNCLSNFQIAGLPTNVAFLQELAGHNAFERGLVDTHFIERYKDDFQSTSAKASGEAHDAAKLGAILAAACICKKDHISSEESLRDKTLSVWYTRPPFRMHHSAKRLMEFELDEELEGLSDELLKLLVTYGSDGGYFIETEDGSSPGFDVKVDGRSEHDFRVEVGGVQTDVTLAFYSKDNSKHIHIWHGKHHHHYRQTMRIEHLLDDSSQPSQASEGRSHPKGSVLAPMAGLVVKVLLKDGVHVEDGQPVMVIEAMKMEHVVKAPRAGYIEGLKATAGQQVFDSSVLFTVKDKSTS

SEQ ID NO: 15233 - protein, 801 aa, Secale cereale
GRNVGDSSSRPSPVTTLIQPSSHTKPTHIPDQTHRPATPPRPSPPPPPHHSAALGSRATGDGLPLLRLHHQLRRRRHRGTSPVPCRLLSSPSAPEPPPPPQTVEKVLVANRGEIACRVMRTARRLGIATVAVYSDADRAALHVRAADEAVRLGPPPARESYLNAAAIVDAALRTGAKAIHPGYGFLSESADFAQLCESEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRTHIGEAAVSAAKAVGYYSAGTVEFIVDTLSGEFYFMEMNTRLQVEHPVTEMIVGQDLVEWQIRVANGERLPLSQEQVPLNGHAFEARIYAENVPRGFLPATGTLHHYRPVLSSPTVRVETGVEEGDAVSMHYDPMIAKLVVWGESRSAALVKLKNCLSNFQIAGLPTNVAFLQELAGHNAFERGLVDTHFIERYKDDFQSTSSKASGEAHDAAKLGAILAAACICKNDHISSEESLRDKTLSVWYTRPPFRMHHSAKRLMEFELDEELEGLSDELLKLLVTYRSDGGYFIETEDGSSPGFDVKVDGRSEHDFRVEVGGVQTDVTLAFYSKDNSKHIHIWHGKHHHHYRQTMRAEHLLDDSSQPSQASEGRSHPKGSVLAPMAGLVVKVLLKDGVHVEDGQPVMVIEAMKMEHVVKAPQAGYIEGLKATAGQQVFDSSVLFTVKDKSTN

SEQ ID NO: 15234 - protein, 737 aa, Brachypodium distachyon
MASRLLRLHPQLRRRRHGASRLLSSSSSSPAEPPAAAMMEKVLVANRGEIACRVMRTARRLGVATVAVYSDADRGALHVRDADEAVRLGPAPARDSYLNASAIVDAALRTGAKAIHPGYGFLSESADFAQLCQAEGLTFIGPPPSAIRDMGDKSASKRIMGAAGVPLVPGYHGAEQDIELLKLEADKIGYPVLIKPTHGGGGKGMRIVQGPDDFVDSVLSAQREAAASFGINTLLIEKYITQPRHIEVQVFGDQHGNAIHLYERDCSLQRRHQKIIEEAPAPNVTTEFRSHIGEAAVSAAKAVGYYSAGTVEFIVDTISGEFYFMEMNTRLQVEHPVTEMIVGQDLVEWQIRVANGERLPLSQEQVQLNGHAFEARIYAENVPRGFLPATGTLHHYRPVTSSKTVRVETGVEEGDTVSMHYDPMIAKLVVWGESRNAALVKLKNCLSNFQIAGLPTNVGFLQELAGHSAFEKALVETHFIERYKDDLLSTSAKTSDESHDAVELGAILAAACICKKDHIASEESLRDKTLSVWYSGSPFRMHHSAKRLMEFEIDKELEGLSDEPLKLHITYKSDGSYFIETIDGSSPGLEIKLDDRSDHDFRVDVGGVQKDVTLAFYTKDDSKHIHIWHGKHHHHYRQTMRAEQSLDDSSQPSHASEGRSYPKGSVLAPMAGLVVKVLLKDGAQVENGQPVMVMEAMKMEHVVKAPRAGYIQGLKATAGQQVFDSSVLFTVQDKSTN

SEQ ID NO: 15235 - protein, 737 aa, Oryza sativa
MASRLLLLPRRRSRHGGASLLLARLLSSSSSEAGGGGAVEKVLVANRGEIACRVMRTARRLGIPTVAVYSDADRGALHVRAADEAVRLGPPPARESYLNASAIVDAALRTGAKAIHPGYGFLSESADFAQLCKAEGLTFIGPPPSAIRDMGDKSASKRIMGAAGVPLVPGYHGAEQDIELLKLEANKIGYPVLIKPTHGGGGKGMRIVQRPEDFVDSVLSAQREAAASFGINTLLVEKYITQPRHIEVQIFGDQHGNVIHLYERDCSLQRRHQKIIEEAPAPNVTAQFRSHIGEAAVSAAKAVGYYSAGTVEFIVDTLSGEFYFMEMNTRLQVEHPVTEMIVGQDLVEWQIRIANGECLPLSQEQVPLNGHAFEARIYAENVPRGFLPATGTLHHYRPVPSTATVRVETGVEEGDTVSMHYDPMIAKLVVWGESRNAALVKLKNSLSNFQIAGLPTNVGFLQELAGHSAFEKGLVDTHFIERYQNDLLSTSTQALSGSHEAEELGAILAAACICKKDHVSSEVSLHDKKLSMWYAHPPFRMHHFAKRLMEFELDRELGGSSDDLLKLSVTYRSDGTYFVETEDGSSPGLDVKVDSRGDHDFRVDVGGLQTDVTLAFYSKDNCNHIHIWHGKHHHHYRQTLRAEQSPDDSSQPSASSEARSHPKGSVLAPMAGLVVKVLLKDGARVEEGQPVMVMEAMKMEHVVKAPCAGYVEGLKATAGQQVFDSSVLFTVKENKPN

SEQ ID NO: 15236 - protein, 737 aa, Oryza sativa
MASRLLLLPRRRSRHGGASLLLARLLSSSSSEAGGGGAVEKVLVANRGEIACRVMRTARRLGIPTVAVYSDADRGALHVRAADEAVRLGPPPARESYLNASAIVDAALRTGAKAIHPGYGFLSESADFAQLCKAEGLTFIGPPPSAIRDMGDKSASKWIMGAAGVPLVPGYHGAEQDIELLKLEANKIGYPVLIKPTHGGGGKGMRIVQRPEDFVDSVLSAQREAAASFGINTLLVEKYITQPRHIEVQIFGDQHGNVIHLYERDCSLQRRHQKIIEEAPAPNVTAQFRSHIGEAAVSAAKAVGYYSAGTVEFIVDTLSGEFYFMEMNTRLQVEHPVTEMIVGQDLVEWQIRIANGECLPLSQEQVPLNGHAFEARIYAENVPRGFLPATGTLHHYRPVPSTATVRVETGVEEGDTVSMHYDPMIAKLVVWGESRNAALVKLKNSLSNFQIAGLPTNVGFLQELAGHSAFEKGLVDTHFIERYQNDLLSTSTQALSGSHEAEELGAILAAACICKKDHVSSEVSLHDKKLSMWYAHPPFRMHHFAKRLMEFELDRELGGSSDDLLKLSVTYRSDGTYFVETEDGSSPGLDVKVDSRGDHDFRVDVGGLQTDVTLAFYSKDNCNHIHIWHGKHHHHYRQTLRAEQSPDDSSQPSASSEARSHPKGSVLAPMAGLVVKVLLKDGARVEEGQPVMVMEAMKMEHVVKAPCAGYVEGLKATAGQQVFDSSVLFTVKENKPN

SEQ ID NO: 15237 - protein, 754 aa, Setaria italica
MASRLLRLHLRRRGGGRSPGSPVPPLPLLLAARLLSSSSSSSAPTSPAAAASPGAGIEKVLVANRGEIACRVMRTARRLGVATVAVYSDADRKALHVRAADEAVRIGPPPARESYLDARAIIDAAHRTGAQAIHPGYGFLSESADFAQLCEAEGLKFIGPPASAIRDMGDKSASKRIMGAAGVPLVPGYHGAEQDIELLKLEADKIGYPVLIKPTHGGGGKGMRIVQRPEEFVDSVLSAQREAAASFGVNTLLIEKYITQPRHVEVQVFGDQHGNAIYLYERDCSLQRRHQKIIEEAPAPNVTAEFRSHIGGAAVSAAKAVGYYNAGTVEFIVDTLSGEFYFMEMNTRLQVEHPVTEMIVGQDLVEWQIRVANGERLPLSQEQVPLNGHAFEARIYAENVPRGFLPATGTLHHYRPVPSASTVRVETGVEEGDTVSMHYDPMIAKLVVWGESRSAALVKLKKCLSNFQIAGLPTNVGFLQELASHSSFEEGIVDTHFIERYKDDLLSTSTKASGESRDVAELGAILAAACICKKDHITSKESIRADKKLSVWYNNTPFRMHHFARQPLELEFEEHDGFSEKLLKLFITYKPDGSYFIETEDGTSGLDVKVDHKGDHDFRVDAAGLQTDVTLAYYSKDNSEHIHIWHGKHHHHYRQTLRTEHVVDDTSQPSHASEGKSHPKGSVLAPMAGLVVKVLLEDGAQVEAGQPVMVMEAMKMEHVVKAPRAGYVEGLKVTAGQQVFDSSVLFTIKDNTAN

SEQ ID NO: 15238 - protein, 751 aa, Zea mays
MASRLLLHLHLRRRGRGIPGCPVPALPLHAARLLSSSPPTAAAASSSAAGGGGIEKVLVANRGEIACRVMRTARRLGVATVAVYSDADRGALHVRAADEAVRIGPPPARESYLNARAIIEAALRTGAQAIHPGYGFLSESADFAQLCEAEGLKFIGPPASAIRDMGDKSASKRIMGAAGVPLVPGYHGADQDVELLKLEADKIGYPVLIKPTHGGGGKGMRIVERPDEFVDSVLSAQREAAASFGVNTLLIEKYITQPRHVEVQVFGDQHGNAIYLYERDCSLQRRHQKIIEEAPAPNVPAEFRSHIGGAAVSAAKAVGYYNAGTVEFIVDTLSGEFYFMEMNTRLQVEHPVTEMIVGQDLVEWQIRVANGERLPLSQEQVPLNGHAFEARIYAENVPRGFLPATGTLHHYRPVPSDPTVRVETGVEEGDTVSMHYDPMIAKLVVWGESRTAALVKLKKCLSTFQIAGLPTNVDFLQELASHSAFEKGLVDTHFIERYKDDLLSISTKSSKESHGVAELGAILAAACICKKEHITSKESLRANKSLSVWYNNPPFRMHHFARHPLDLELEENDGFSEKLLKLFITHKSDGSYFIETEDGTSGLDVKVDHKGDHDFRVDVSGLQTDVTLASYSKGNSKHIHVWHGNHHHHYRQTVRAEHAVDDSSQPSHASEGKSHPKGSVLAPMAGLVVKVLLEDGAQVDAGQPVMVMEAMKMEHVVKAPRAGYVSGLKVTAGQQVFDSSVLFTIKDSSAN

SEQ ID NO: 15239 - protein, 751 aa, Zea mays
MASRLLLHLHLRRRGRGIPGCPVPALPLHAARLLSSSPPTAAAASSSAAGGGGIEKVLVANRGEIACRVMRTARRLGVATVAVYSDADRGALHVRAADEAVRIGPPPARESYLNARAIIEAALRTGAQAIHPGYGFLSESADFAQLCEAEGLKFIGPPASAIRDMGDKSASKRIMGAAGVPLVPGYHGADQDVELLKLEADKIGYPVLIKPTHGGGGKGMRIVERPDEFVDSVLSAQREAAASFGVNTLLIEKYITQPRHVEVQVFGDQHGNAIYLYERDCSLQRRHQKIIEEAPAPNVPAEFRSHIGGAAVSAAKAVGYYNAGTVEFIVDTLSGEFYFMEMNTRLQVEHPVTEMIVGQDLVEWQIRVANGERLPLSQEQVPLNGHAFEARIYAENVPRGFLPATGTLHHYRPVPSDPTVRVETGVEEGDTVSMHYDPMIAKLVVWGESRTAALVKLKKCLSTFQIAGLPTNVDFLQELASHSAFEKGLVDTHFIERYKDDLLSISTKSSKESHGVAELGAILAAACICKKEHITSKESLRANKSLSVWYNNPPFRMHHFARHPLDLELEENDGFSEKLLKLFITHKFDGSYFIETEDGTSGLDVKVDHKGDHDFRVDVSGLQTDVTLASYSKGNSKHIHVWHGNHHHHYRQTVRAEHAVEDSSQPSHASEGKSHPKGSVLAPMAGLVVKVLLEDGAQVDAGQPVMVMEAMKMEHVVKAPRAGYVSGLKVTAGQQVFDSSVLFTIKDSSAN

SEQ ID NO: 15240 - protein, 752 aa, Sorghum bicolor
MASRLLHLHLRRGRVRVRGGSPAGSPVPAPAPARLLSSSPPPTASSASAGGGGGIEKVLVASRGEIACRVMRTARRLGVATVAVYSDADRGALHVRAADEAVRIGPPPARQSYLNAGAIIDAALRTGAQAIHPGYGFLSESADFAQLCETEGLKFIGPPASAIRDMGDKSASKRIMGAAGVPLVPGYHGADQDIELLKLEADKIGYPVLIKPTHGGGGKGMRIVERPDEFVDAVLSAQREAAASFGVNTLLIEKYITQPRHVEVQVFGDQHGNAIYLYERDCSLQRRHQKIIEEAPAPNVTAEFRSHIGGAAVSAAKAVGYYNAGTVEFIVDTLSGEFYFMEMNTRLQVEHPVTEMIVGQDLVEWQIRVANGERLPLSQEQIPLNGHAFEARIYAENVPRGFLPATGTLHHYRPVPSDPTVRVETGVEEGDTVSMHYDPMIAKLVVWGESRTAALVKLKNCLSNFQIAGLPTNIGFLQELASHSAFEKGLVDTHFIERYKDDLLSISTKSSEESHGVAVLGAILAAACICKKDHITFKESQRANNTLSVWYNNPPFRMHHFARHPLDLELEENDGFSEKLLKLFITHKSDGSYFIETEDGTSGLDVKVDHKGDHDFRVDVSGLQTDVTLASYSKGNSKHIHVWHGKHHHHYRQTVRAEHAVDDSSQPCHASEGKSHPKGSVLAPMAGLVVKVLLEDGAQVEAGQPVMVMEAMKMEHVVKAPRAGYVDGLKVTAGQQVFDSSVLFTIKDNIAN

SEQ ID NO: 15241 - protein, 752 aa, Sorghum bicolor
MASRLLHLHLRRGRVRVRGGSPAGSPVPAPAPARPLSSSPPPTASSASAGGGGGIEKVLVANRGEIACRVMRTARRLGVATVAVYSDADRGALHVRAADEAVRIGPPPARQSYLNAGAIIDAALRTGAQAIHPGYGFLSESADFAQLCETEGLKFIGPPASAIRDMGDKSASKRIMGAAGVPLVPGYHGADQDIELLKLEADKIGYPVLIKPTHGGGGKGMRIVERPDEFVDAVLSAQREAAASFGVNTLLIEKYITQPRHVEVQVFGDQHGNAIYLYERDCSLQRRHQKIIEEAPAPNVTAEFRSHIGGAAVSAAKAVGYYNAGTVEFIVDTLSGEFYFMEMNTRLQVEHPVTEMIVGQDLVEWQIRVANGERLPLSQEQIPLNGHAFEARIYAENVPRGFLPATGTLHHYRPVPSDPTVRVETGVEEGDTVSMHYDPMIAKLVVWGESRTAALVKLKNCLSNFQIAGLPTNIGFLQELASHSAFEKGLVDTHFIERYKDDLLSISTKSSEESHGVAVLGAILAAACICKKDHITFKESQRANNTLSVWYNNPPFRMHHFARHPLDLELEENDGFSEKLLKLFITHKSDGSYFIETEDGTSGLDVKVDHKGDHDFRVDVSGLQTDVTLASYSKGNSKHIHVWHGKHHHHYRQTVRAEHAVDDSSQPCHASEGKSHPKGSVLAPMAGLVVKVLLEDGAQVEAGQPVMVMEAMKMEHVVKAPRAGYVDGLKVTAGQQVFDSSVLFTIKDNIAN

SEQ ID NO: 15242 - protein, 537 aa, Panicum virgatum
MWLSGAAISAPLGCRGLRRGAVGGGGKARRAEAERWRRAGAGRRSGGAKVRCVATEKHDETTAAAAVGVEFADEEDYRKGGGGEILYVQMQATKPMESQSKIASKLLPISDENSVLDLVIIGCGPAGLSLASESAKKGLTVGLIGPDLPFTNNYGVWEDEFKDLGLESCIEHVWKDTIVYLDNNKPILIGRSYGRVHRDLLHEELLRRCYEAGVTYLNSKVDKIIESPDGHRVVCCERGREILCRLAIVASGAASGRLLEYEVGGPRVCVQTAYGVEVEVENNPYDPSLMVFMDYRDCFQEKFSHSEQENPTFLYAMPMSSTRVFFEETCLASKDAMPFDVLKKRLMYRLDAMGVRILKVHEEEWSYIPVGGSLPNTDQKNLAFGAAASMVHPATGYSVVRSLSEAPRYASLISDILRNRVPAQYLAGSSQNYSPSMLAWRTLWPQERKRQRSFFLFGLALIIQLNNEGIQTFFEAFFRVPKWMWQGFLGSTLSSVDLILFSFYMFAIAPNQLRMNLVRHLLSDPTGSTMIKTYLTL

SEQ ID NO: 15243 - protein, 540 aa, Setaria italica
MGLSGAAISAPLGCRGLPHGAVGGGSKVRRAEVERWRRREGAGRRVAGPKVRCVATEKHDETAAVGAAAAGVEFADEEDYRKGGGGELLYVQMQATKPMESQSKIASKLLPISNENSVLDLVIIGCGPAGLSLASESAKKGLTVGLIGPDLPFTNNYGVWEDEFKDLGLESCIEHVWKDTIVYLDNNEPILIGRPYGRVHRDLLHEELLRRCYEAGVTYLNSKVDKIIESPDGHRVVCCERGREILCRLAIVASGAASGRLLEYEVGGPRVCVQTAYGVEVEVENNPYDPSLMVFMDYRDCFKEKFSHSEQENPTFLYAMPMSSTRVFFEETCLASKDAMPFDVLKKRLMYRLDAMGVRILKVHEEEWSYIPVGGSLPNTDQKNLAFGAAASMVHPATGYSVVRSLSEAPRYASVISDILRNRVPAQYLPGSSQNYSPSMLAWRTLWPQERKRQRSFFLFGLALIIQLNNEGIQTFFEAFFRVPKWMWRGFLGSTLSSVDLILFSFYMFAIAPNQLRMNLVRHLLSDPTGSTMIKTYLTL

SEQ ID NO: 15244 - protein, 765 aa, Oryza sativa
MQGGGPLSPDEHRATSPPGIMHHQPAMTIVVAVDRDRNSQLAVKWVVDHLLTGASNIILLHIAVHPPAANHGFAMAEATHGALEAEMREIFVPFRGFCTRNGVHVSELVLEEADVSKALIEFITVNKIQSIALGASNRNAFTKKFKNADVPSSLMKGAPDYCNIYVVAKGKSVNVRLAKCGVDGGCGGGGGYEGDSSIRSLYTRRCSRGKLPPATPSPDSSRRSVDSRTLPELTTRPPFRERSLPSSSSKPVVLSSRAAPDCGGGGVDGSYRSTRRSVSNESFVGDLDFGQSSRFSSMDFCDSLDMSSLSASPRESSSPLSAPQREVEVEMRRLRLELKQTMDMYNAACREAINAKQRTKELQLLKLEEARRLEEARHAEEAALAMAEMEKTKCRAAMEAAEAAQRLADLEAQRRRNAEVRARREADEKVRALDAISSHDFRYRRYNIDDIELATERFSDELKIGEGGYGPVYRASLDHTPVAIKVLRPDAQQGRKQFQQEVEVLSCIRHPNMVLLLGACPDYGCLVYEYMDNGSLEDRLFRRGGTPPIPWSQRFRISAEIATALLFLHQTKPEPLVHRDLKPANILLDRNYVSKISDVGLARLVPPAVADSVTQYRLTATAGTFCYIDPEYQQTGKLGVKSDIYSLGVLLLQVLTARPPMGLTHHVEKAIDAGTFAQMLDVTVKDWPVDDAIGFAKLALKCTEMRRRDRPDLATVILPELNRLRNLGHAYEARMSAAAADAAAHAQDNVGSPTVVGASWRTAES

SEQ ID NO: 15245 - protein, 540 aa, Oryza sativa
MEFSGGATVSAPFGCCRAAWGAAAAGAGAEGRSRRVVPRAVEPRRRGRWMVRCVATEKHKDAAARRGGVEVEFADEEDYVKGGGGELLYVQMQASKSMDSQSKISSKLLPIPDENSVLDLVIIGCGPAGLSLAAESAKKGLNVGLIGPDLPFTNNYGVWEDEFKDLGLESCIEHVWKDTIVYLDGNKPIMIGRAYGRVHRDLLHEELLRRCYDAGVTYLSSKVDKIMESPDGHRVVCCEGDREVLCRLAIVASGAASGRLLEYEVGGPRVCVQTAYGVEVEVENNPYDPSLMVFMDYRDCFKDKFSHPEQGNPTFLYAMPMSSTRIFFEETCLASKEAMPFDLLKKRLMSRLDAMGVHIRKVYEEEWSYIPVGGSLPNTDQKNLAFGAAASMVHPATGYSVVRSLSEAPRYASVISDILRNRVYPGQYLPGTSQSSSPSMLAWRTLWPQERKRQRSFFLFGLALIIQLNNEGIQTFFETFFRLPKWMWRGFLGSTLSSVDLILFAFYMFTIAPNQMRMNLVRHLLSDPTGSTMIKTYLTL

SEQ ID NO: 15246 - protein, 532 aa, Secale cereale
MESTGAAISAPFGCRALRWPGQRPLRAADARRRRVGPEQWRSLKASCVATEKPDEKAAPGLGVDFADEEDYVKGGGGELLYVQMQATKAMERQSKIASKLLPIADETSVLDLVIIGCGPAGLSLAAESAKKGLTVGLIGPDLPFTNNYGVWEDEFKDLGLESCIEHVWKDTVVYLDRNKPIMIGRAYGRVDRDLLHEELLRRCNEAGVTYLNSKVEQIIESPDGHRVVYCGRDRKILCRLAIVASGAASGKLLEYEVGGPRVCVQTAYGVEVEVERYPYDPSLMVFMDYRDCFKEKFSHPEEANPTFLYAMAMSSTRVFFEETCLASKDAMPFDLLKKRLMSRLDAMGVRIVKVYEEEWSYIPVGGSLPNTDQKNLAFGAAASMVHPATGYSVVRSLSEAPRYASVISDILRNRVYSGQYLPGSSEMSSPSMLAWGTLWPQERKRQRSFFLFGLALIIQLDNEGIQTFFETFFRLPKWMWRGFLGSTLSSVDLMLFALYMFAIAPNNLRMNLVRHLLSDPTGSAMIRTYLTL

SEQ ID NO: 15247 - protein, 544 aa, Brachypodium distachyon
MEFTGATVSAPFGCRALRGGGQRPLRAAGLAADGRRRRAAGSKPGAQQWRNNRKVRCVATEKHKDNKAAAAGLGVEFADEEDYVKGGGGELLYVQMQATKAMESQSKIASKLSPIADETSVLDLVVIGCGPAGLSLAAESAKKGLTVGLIGPDLPFTNNYGVWEDEFKDLGLESCIEHVWKDTIVYLDHNEPIMIGRAYGRVHRDLLHEELLRRCNEAGVTYLNSKVDKIIESPDGHRVVYCERGHKILCRLAIVASGAASGKLLEYEVGGPRVCVQTAYGVEVEVEQFPYDPSLMVFMDYRDCFKENFSHPEEANPTFLYAMPMSSTRVFFEETCLASKEAVPFELLKKRMMFRLDAMGVRILKVYEEEWSYIPVGGSLPNTDQKNLAFGAAASMVHPATGYSVVRSLSEAPRYASVISDILRNRVYSGQYLPGSSQDSSPSMLAWRTLWPPERKRQRSFFLFGLALIIQLDNEGIQTFFETFFRLPKWMWRGFLGSTLSSVDLMLFALYMFAIAPNTLRMNLVRHLLSDPTGSAMIKTYLAL

SEQ ID NO: 15248 - protein, 536 aa, Triticum aestivum
MESTGAAISAPFGCRALRWAGQRPLRPADGRRRRVGPGPGPEQWRSLKASCVATEKPDEKAAPGLGVEFADEEDYVKGGGGELLYVQMQATKAMESQSKIASKLLPIADETSVLDLVIIGCGPAGLSLAAESAKKGLTVGLIGPDLPFTNNYGVWEDEFKDLGLESCIEHVWKDTVVYLDRNKPIMIGRAYGRVDRDLLHEELLRRCNEAGVTYLNSKVEQIKESPDGHRVVYCGRGRKILCRLAIVASGAASGKLLEYEVGGPRVCVQTAYGVEVEVERYPYDPSLMVFMDYRDCFKEKFTHPEEANPTFLYAMAMSSTRVFFEETCLASKDAMPFDLLKKRLMSRLDAMGVRIIKVYEEEWSYIPVGGSLPNTDQKNLAFGAAASMVHPATGYSVVRSLSEAPRYASVISDILRNRVYSGQYLPGSSEMSSPSMLAWGTLWPQERKRQRSFFLFGLALIIQLDNEGIQTFFESFFRLPKWMWRGFLGSTLSSADLMLFALYMFAIAPNTLRMNLVRHLLSDPTGSAMIRTYLTL

SEQ ID NO: 15249 - protein, 740 aa, Brassica rapa
MDDHESPLLSKEPSSSSSSSVVASSFKWILKVLMSVIFVAWIVFLFVYPGKLGDGILTNWRAVSSNTLFGTTGSMFLIFSGPILVISVLASLYLIISGEEKVFAKKKISKFPRFRLWTFPVLVDGPFGVVSAAEFLVIMIFSVFFLWAIYAYTMRDLDLLDLFHVLPEDRSMLLLEITGLRFGMIGLLCMVFLFLPISRGSILLRLVDIPFEHATKYHVWLGHITMAFFSFHGLCYVVAWTVQGRLLELLFEWKAIGIAVLPGVISLVAGLLMWVTSLQYVRKHYFELFFYTHQLYIVFVVFLALHVGDYLFSIVAGGIFLFILDRFLRFCQSRRTVDVISAKSFPCGTLELVLSKPPNMRYNALSFVFLQVRELSWLQWHPFSVSSSPLDGKHHVAVLIKVLGGWTAKLRDQLSKLYEAENQDQLLSPLSYPKITTCVEGPYGHESPYHLAYENLVLVAGGIGISPFFAILSDILQRKRDGKACLPKKVLVIWAIKNSDELSLLSSIDIPSLCPSFSQKINLEINIYVTRQSEPLLEDGMVHKMVNPSVKPRSNGCPMSVLVGTGDNIWAGLYLVSSTIGFVLMITLLDIFYINKFNITAWWYKGLLFVVCMVASVLIFGGLVVVFWNLWGEKAGDVEPNGHDKVTTNGEELHNPSAELKGLNTEDDIQSFITTRYGTRPDFKEIFESLNEKWGSVDVGVIVCGPASLQSTVAKEIRSHSIWRSTNHPLFHFNSHSFDL

SEQ ID NO: 15250 - protein, 741 aa, Arabidopsis lyrata
MDDHESPLLSKESPPSSSSVLVSSLKWILKVVMSVIFVTWVVFLMMYPGSLGDQVLTNWRAISSNTLFGITGSMFLIFSGPILVIAVLASLYLIISGEERVFTKKKISKFPRFRLWTFPVLVDGPFGVVSAAEFLGIMVFSVFFLWAIYAYTLRNLNVLEYFHVLPKNRSIFLLELTGLRFGMIGLLCMVFLFLPISRGSILLRLIDIPFEHATRYHVWLGHITMAFFSLHGLCYVVGWTIQGQLLELLFEWKDTGIAVLPGVISLVAGLLMWVTSLHTVRKFYFELFFYTHQLYIVFVVFLALHVGDYLFSIVAGGIFLFILDRFLRFCQSRRTVDVISAKSLPCGTLELVLSKPPNMRYNALSFIFLQVRELSWLQWHPFSVSSSPLDGNHHVAVLIKVLGGWTAKLRDQLSNLYEAENQDQLISPDSYPKITTCVEGPYGHESPYHLAYENLVLVAGGIGITPFFAILSDILHRKRDGKACLPSKVLVVWAIKNSDELSLLSAIDVPSICPFFSKKLSLEIHIYVTRQSEPRLEDGMVQMVVHPSVKPPRTNGCSMSVLVGTGDNIWSGLYLIVSTIGFIAMITFLDVFYINKYNITTWWYKGLLFIVCMVASVLIFGGLVVVFWHRWGHKTGKVEANGNDKVYLNGEETHNPYAAELKGLDIEEDVQSYTTIRYGTRPAFREIFESLNGKWGSVDVGVIVCGPATLQTTVAKEIRSHSIWRSANHPLFHFNSHSFDL

SEQ ID NO: 15251 - protein, 742 aa, Arabidopsis lyrata
MDDHKTPLLSKDSSSSSSSTSSVVTSSLKWVLKVVMSMIFVTWIVFLMILYPEQLGDDFLTVVASKTFLGTTGSMFLIFSGPILVIAVLASLYLIISGEDKVFTKNKISKFPRFRLWTFPVLVDGPFGVVSAAEFLGIMVFSVFFLWAIYAYTLRNLDLLERFHVLPKNRSILLLEVTGLRLGVIGLLCMVFLFLPISRGSILLRLIDIPFEHATRYHVWLGHITMAFFSLHGLCYVVGWTIQGQLLELIFSWNAIGIAVLPGVISLVAGLLMWVTSLHTVRKHYFELFFYTHQLYIVFVVFLALHVGDYLFSIVAGGIFLFILDRFLRFCQSRRTVDVISAKSLPCGTLELVLSKPPNMRYNALSFIFLQVRELSWLQWHPFSVSSSPLDGNHHVAVLIKVLGGWTAKLRDQLSNLYEAENQDQLISPDSYPKITTCVEGPYGHESPYHLAYENLVLVAGGIGITPFFAILSDILHRKRDGKACLPSNVLLVWAIKNSDELSLLSAIDIPSICPFFSKKLNLEIHIYVTRQSEPRLEDGMVHKVVHPSVKPPRTNRCSMSVLVGTGDNIWSGLYLIVSTIGFIAMITLLDIFYIKKYNITTWWYKGLLFVVCMVASVLIFGGLVVVFWHRWGHKIGEVEGNGNDKVNLNGEETHNPSAAELKGLATEEDVQSYTTIRYGTRPNFREIFASLNGKWGSVDVGVIVCGPGTLQTTVAKEIRSHSIWRSANHPLFHFNSHSFDL

SEQ ID NO: 15252 - protein, 738 aa, Arabidopsis thaliana
MDDYETPLLSKDSSSSSSVITSSLKWILKVVMSMIFVTWVVFLMMMYPEQLGDDFLTFVSSKTFLGTTGTMFLIFSCPILVISVLASLYLIISGEDKVFTKKKISKFPRFRLWTFPVLVDGPFGVVSAAEFLGIMVFSVFFLWSIYAYTLRNLDLLERFHVLPKNRSILLLEVTGLRLGMIGLLCMVFLFLPISRGSILLRLIDIPFEHATRYHVWLGHITMAFFSLHGLCYVVGWIIQGQLLELIFSWNAIGIAILPGVISLVAGLLMWVTSLHTVRKNYFELFFYTHQLYIVFIVFLALHVGDYMFSIVAGGIFLFILDRFLRFCQSRRTVDVISAKSLPCGTLELVLSKPPNMRYNALSFIFLQVRELSWLQWHPFSVSSSPLDGNHHVAVLIKVLGGWTAKLRDQLSNLYEAENQDQLISPQSYPKITTCVEGPYGHESPYHLAYENLVLVAGGIGITPFFAILSDILHRKRDGKACLPSKVLVVWAIKNSDELSLLSAIDIPSICPFFSKKLNLEIHIYITRQSEPRLEDGMVHKVVHPSVKLPRTNGCSMSVLVGTGDNIWSGLYLIISTIGFISMITLLDIFYIKRYNITTWWYKGLLFVGCMVASVLIFGGLVVVFWHRWEHKTGEVEANGNDKVDLNGEETHNPSAAELKGLAIEEDVQNYTTIRYGTRPAFREIFESLNGKWGSVDVGVIVCGPATLQTTVAKEIRSHSIWRSANHPLFHFNSHSFDL

SEQ ID NO: 15253 - protein, 260 aa, Gossypium raimondii
MLLKAVPTFSSLNPQLENQGALFFPFSSSINHQLSSLRNGPGSLVVCAAKGANHKPLSGVVFQPFVEVKKELDLVPSVPQLSLARQKFTDDCEASINEQINVEYNVSYVYHAMFAYFDRDNVALKGLAKFFKESSLEEREHAEKFMEYQNKRGGKVKLQSIVMPLSEFDHAEKGDALYAMELALSLEKLTSEKLFNLRNVAVRNHDVQLTDFIEGEFLAEQVEAIKKISEYVAQLRRVGKGHGVWHFDQMLLHEGEEAIA

SEQ ID NO: 15254 - protein, 576 aa, Ceratodon purpureus
MMEAVAAMATPPLALSAATAAVASSSCCCSSSVSRGLYAARWRGLESSSSLQMGGREFQGWKFVENSRGGRGAAWSLRVRADAGVAVKERVGGDERPKLTQGFTTVMKFGGSSVASAHRMREVAQLILSFPEERPVIVLSAMGKTTNNLLKAGEKAVTCGVKESGKIEELQVLRDLHKTTARELKVDESLITDLLDELEQLLLGIALMKELTVRTKDYLVSFGERLSTRLFAAYLNSIGTYARQYDAFDLGIITTDEFTNAEILETTYPTVRERLLNDLEKDADRGTPICVVTGFLGKGVETGCVTTLGRGGSDLTATALGKALGLREIQVWKDVDGVLTCDPRVFANALPVPFLTFDEASELAYFGAQVLHPQSMRPARDANIPVRVKNSYNPQAPGTLITGERDMSKAEMTSIVLKKDVTMLDIQSTRMLGQVGFLAKVFTTFEDLGISVDVVATSEVSISLTLDPSKLWERALIEQELDKMKAELSRIANVQLLKKKAIISLISNVKQSSAVLEKVFRVFKKNNINVQMISQGASKVNISMVVDDEDAPKCVQELHKVFWPDSDEVMTGNGHL

SEQ ID NO: 15255 - protein, 578 aa, Physcomitrella patens
MMEVAVAMAIPTLTLSAAASSSCASSSTCRSLNLSQGPRWRRLESSSSSHFMPAGSSLLQEFKFVENSRRDRTRVWSLQVRCDAGVSVVKELVGEDEGRRIVQDFTTVMKFGGSSVASAHRMKEVAQLILSFPEEKPIIVLSAMGKTTNNLLKAGDKAISCGVKNSGRIEELQVVRDLHKTTARELKLDESLITGLLDELEQLLMGIALMKELTSRTKDYLVSFGERLSTRLFAAYLNSIGTYARQYDSFDLGIITTDEFTNAEILDVTYPTVRERLFNDLEKDAAKGTPICIVTGFLGKGIETGCVTTLGRGGSDLTATALGKALGLREIQVWKDVDGVLTCDPRVFPSALSVPFLTFNEASELAYFGAQVLHPQSMRPARDANIPVRVKNSYNPKAPGTLITRERDMSQVEMTSIVLKKDVTMLDIQSTRMLGQVGFLAKVFTTFEELGISVDVVATSEVSISLTLDPAKLWERALIEQELDKMKSELSRIANVQLLKKKAIISLISNVKQSSAVLEKVFSVFKSNNINVQMISQGASKVNISMVVDDDDGPKCVQELHQAFWPDSDEVLAVNGHL

SEQ ID NO: 15256 - protein, 574 aa, Unknown
  Sequence found in Organisms: Brassica napus, Brassica rapa
MAAAARVQCHNNTSLTGSPLPRRRRNSPTLHFSPNRVNFTPLKWIGDGSSSCTRMVSGPSLKGGTTTVRAALEEEKKTDAVSEVVEEEKRFTCVMKFGGSSVATAERMREVADLVLTFPEESPVIVLSAMGKTTNNLLLAGEKAVSCGVSNASEIEELSVIKELHLRTVKELEIDPSVVSSFLEELEQLLKGIAMMKELTLRTRDYLVSFGECLSTRIFAAYLNKIGVKARQYDAFEIGFITTDDFTNGDILEATYPAVAKRLYDDWMDDPAVPVVTGFLGKGWKTCAVTTLGRGGSDLTATTIGKALGLQEIQVWKDVDGVLTCDPTIYKRATPVPFLTFDEAAELAYFGAQVLHPQSMRPAREGGIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLAKGRAIISLIGNVQHSSLILERAFHVLWTKGINVQMISQGASKVNISLIVNDAEAEGCVEALHKSFFESGDLSELLIQPRLGNGSPVRTMQVEN

SEQ ID NO: 15257 - protein, 571 aa, Brassica rapa
MAAAARVRCHCNALFTSHRNSSTLPISPSRVGFTALKCPRKFLLSIGDGSSSCTRNVSGSCLKGTVRAVMEEEKTDVIKEREGDEKRFTCVMKFGGSSVATAERMREVADLILAFPEESPVIVLSAMGKTTNNLLLAGEKAVSCGVSNASEIEELSVIKELHLRTVKELKIDPSVVTSFLEELEQLLKGIAMMKELTLRTRDYLVSFGECLSTRIFAAYLNKIGVNARQYDAFEIGFITTDDFTNGDILEATYPAVAKRLYDDWMHDPAIPIVTGFLGKGWKTGAITTLGRGGSDLTATTIGKALGLQEIQVWKDVDGVLTCDPTIYKRATPVPFLTFDEAAELAYFGAQVLHPQSMRPAREGEIPVRVKNSYNPKAPGTIITKTRDMTKTVLTSIVLKRNVTMLDIASTRMLGQVGFLAKVFSIFEDLEISVDVVATSEVSLSLTLDPSKLWSRELIQQELDHVVEELEKIAVVNLSKGRAIISLIGNVQHSSLILERAFHVLWTKGINVQMISQGASKVNISLIVNDDEAEGCVEALHKSFFESGDLSELLIQPRLGNGSPLRTMQVEN

SEQ ID NO: 15258 - protein, 402 aa, Brassica rapa
MLFSFSSMEQRRRKRYCNTVHLLLFIFLVFSSRTSASCRRRAVKHLSTAPPSSTPLESKITSKVIVVSIVSGVLTGLVSALALAFLVRSTVKYLKQTPILKGPVVFSPKITPKSLHAALANGIQLLGSDPNGKYYKMVLDNGLVVAVKRLGSLEGNGGSPEATKSVKRRLQKELELLAGLRDRNLMSLRAYVRESDEFSLVYDYTPNGSLEDVMTKVRAQELELGWEIRLRVAVGIVKGLQYLHFSCEQQILHYNLKPTNVMLDSEFEPRLADCGLAKIIPASHTSVSCYSAPESSQTNRYTDKSDVFSFGMILGVLLTGRDPTLPFSIEGASGGSLGQWLKHLQQTGEVREALDKSILGEEVEEDEMLMALRITIICLSDFPADRPSSDELVHMLTQLHSF

SEQ ID NO: 15259 - protein, 574 aa, Eutrema parvulum
MAAARVRCHSNAPFTRLPLTRHRNSSTLPVSPNRIDFAALKGPKKLLLPIGDGSSCTRMVSAPCLKGTVRAVLEEKKTDAIKETEVDEKSFTCVMKFGGSSVATAERMREVADLILTFPEETPVIVLSAMGKTTNNLLLAGEKAVSCGVSNASEIEELSIIKELHFRTVKELKIDPSVVSPFLEELEQLLKGIAMMKELTLRTRDYLVSFGECLSTRIFAAYLTKMGVKARQYDAFDIGFITTDDFTNGDILEATYPAVAKRLYDDWMHDPAVPIVTGFLGKGWKTGAITTLGRGGSDLTATTIGKALGLQEIQVWKDVDGVLTCDPTIYKHATPVPYLTFDEAAELAYFGAQVLHPQSMRPAREGEIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLSKGRAIISLIGNVQHSSLILERAFHVLWTKGINVQMISQGASKVNISLIVNDAEAEGCVEALHKSFFESGDLSELLIQPRFGNGSPARTMKVEN

SEQ ID NO: 15260 - protein, 571 aa, Eutrema halophilum
MAATRVRCHAPFTRLPHIPNRNSSTLQISPNRVDFASLKGPKKLFLHIGDGYSTRRDSGSCLRTTVRAVLDEKKTDAIAETEVEEKRFTCVMKFGGSSVATAERMREVADLILTFPEECPVIVLSAMGKTTNNLLLAGEKAVSCGVSNASEIEELSIIKELHLRTVKELNIDSSVILSFLEELEQLLKGIAMMKELTLRTRDYLVSFGECLSTRIFAAYLNKLGVKARQYDAFEIGFITTDDFTNGDILEATYPAVAKRLYDDWMHDPAVPIVTGFLGKGWKTGAVTTLGRGGSDLTATTIGKALGLKEIQVWKDVDGVLTCDPTIYKRATPVPYLTFDEAAELAYFGAQVLHPQSMRPAREGEIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLSKGRAIISLIGNVQHSSLILERAFHVLWTKGINVQMISQGASKVNISLIVNDAEAEGCVEALHKSFFESGDLSELLIQPRFGNGSPVRTMQVEN

SEQ ID NO: 15261 - protein, 569 aa, Arabidopsis thaliana
MAATRVRCCHSNAAFTRLPLTRHRNSPTLPISLNRVDFPTLKKLSLPIGDGSSIRKVSGSGSRNIVRAVLEEKKTEAITEVDEKGITCVMKFGGSSVASAERMKEVADLILTFPEESPVIVLSAMGKTTNNLLLAGEKAVSCGVSNASEIEELSIIKELHIRTVKELNIDPSVILTYLEELEQLLKGIAMMKELTLRTRDYLVSFGECLSTRIFAAYLNTIGVKARQYDAFEIGFITTDDFTNGDILEATYPAVAKRLYDDWMHDPAVPIVTGFLGKGWKTGAVTTLGRGGSDLTATTIGKALGLKEIQVWKDVDGVLTCDPTIYKRATPVPYLTFDEAAELAYFGAQVLHPQSMRPAREGEIPVRVKNSYNPKAPGTIITKTRDMTKSILTSIVLKRNVTMLDIASTRMLGQVGFLAKVFSIFEELGISVDVVATSEVSISLTLDPSKLWSRELIQQELDHVVEELEKIAVVNLLKGRAIISLIGNVQHSSLILERAFHVLYTKGVNVQMISQGASKVNISFIVNEAEAEGCVQALHKSFFESGDLSELLIQPRLGNGSPVRTLQVEN

SEQ ID NO: 15262 - protein, 570 aa, Arabidopsis lyrata
MAATRVRCCHSNAPFTRLPYTRHRNSPTLPISLNRVDFSALKCSRRLSLPIGDGSSIRNVSGSGCRNIVRAILEEKTEALTEVDEKGFTCVMKFGGSSVASAERMKEVADLILTFPEESPVIVLSAMGKTTNNLLLAGEKAVSCGVSNASEIEELSIIKELHIRTVKELNIDPSVILTYLEELEQLLKGIAMMKELTLRTRDYLVSFGECLSTRIFAAYLNTIGVKARQYDAFEIGFITTDDFTNGDILEATYPAVAKRLYDDWMHDPAVPIVTGFLGKGWKTGAVTTLGRGGSDLTATTIGKALGLKEIQVWKDVDGVLTCDPTIYKRATPVPFLTFDEAAELAYFGAQVLHPQSMRPAREGEIPVRVKNSYNPKAPGTIITKTRDMTKSILTSIVLKRNVTMLDIASTRMLGQVGFLAKVFSIFEELGISVDVVATSEVSISLTLDPSKLWSRELIQQELDHVVEELEKIAVVNLLKGRAIISLIGNVQHSSLILERAFHVLYTKGVNVQMISQGASKVNISFIVNEAEAEGCVQALHKSFFESGDLSELLIQPRLGNGSPIRMQVEN

SEQ ID NO: 15263 - protein, 503 aa, Eutrema halophilum
MALIQPPIQGNSSACANEIIQLSSTIRCFSRSAVQQHISSPACFRHVTSVSVTPTTCSTKIPNERIGKMSPGLISTRHRVDPKKELSRILRTDAAVKGIERKANSEKYNTLWPKAVLEALDEAISENRWQSALKIFNLLRKQHWYEPRCKTYTKLLKVLGNCKQPEQASLLFEVMLSEGLKPTIDVYTSLIAVYGKSGLLDKAFATLEYMKSVSDCKPDVFTFTVLISCCCKLGRFDLVKRILLEMSYLGVRCSTVTYNTIIDGYGKAGMFEEMENVLADMIEDGDSHPDVFTFNSIIGSYGNGGNTRKMESWYNRFQLMGVQPDITTFNILILSFGKAGMFKKMSSVMDFMEKRFFSLTTVTYNIVIETFGKAGRIEKMDETFRKMKYQGVKPNSITYCSLVNAYSKAGLVVKIDSVLRQIVNSDVVLDTPFFNCIINAYGQAGDLATMKELYLQMEERKCKPDKITFATMIKTYAAHGIFDAVQELEKQMISTGENSSFLL

SEQ ID NO: 15264 - protein, 497 aa, Arabidopsis thaliana
MALIQNPVQGTTSAYANEIAQLGFSRSVVQQHISSPVYFRCIPTISITPTMCSTKVPNERTEKMNSGLISTRHQVDPKKELSRILRTDAAVKGIERKANSEKYLTLWPKAVLEALDEAIKENRWQSALKIFNLLRKQHWYEPRCKTYTKLFKVLGNCKQPDQASLLFEVMLSEGLKPTIDVYTSLISVYGKSELLDKAFSTLEYMKSVSDCKPDVFTFTVLISCCCKLGRFDLVKSIVLEMSYLGVGCSTVTYNTIIDGYGKAGMFEEMESVLADMIEDGDSLPDVCTLNSIIGSYGNGRNMRKMESWYSRFQLMGVQPDITTFNILILSFGKAGMYKKMCSVMDFMEKRFFSLTTVTYNIVIETFGKAGRIEKMDDVFRKMKYQGVKPNSITYCSLVNAYSKAGLVVKIDSVLRQIVNSDVVLDTPFFNCIINAYGQAGDLATMKELYIQMEERKCKPDKITFATMIKTYTAHGIFDAVQELEKQMISSGENLDIL

SEQ ID NO: 15265 - protein, 462 aa, Eutrema parvulum
GDFRCIAFCSMTPTTCSTKNPNERTGKMSSGLISTRHRVDTKKELSRILRTDAAVKGIERKANSEKYNTLWPKAVLEALDEAIIENRWQSALKIFNLLRKQHWYEPRCKTYTKMFKVLGNCKQPEQASLLFEVMLSEGLKPTIDVYTSLIAVYGKCELLDKAFAMLEYMKSVSDCKPDVFTFTVLISCCCKLGRFDLVKRILVEMSYLGVRCSTVTYNTIIDGYGKAGMFEEMENVLADMIEDGDSLPDVFTFNSIVGSYGNGGNTRKMESWYNRFQLMGVQPDITTFNILILSFGKAGMYKKMSSVIDFMEKRFFSPTTITYNIVIQTFGKAGRIEKMDDMFRKMKYQGVKPNSITYSSLVSAYSKAGLVVKIDSVLRQIVNSDVVLDTAFFNCIINAYGQAGDLATMKELYIQMEERKCKPDKITFATMIKTYAVHGIFDAVHELEKQMISTGENSSILL

SEQ ID NO: 15266 - protein, 702 aa, Sorghum bicolor
MPVAALHPPPVAVGAGRRSCRRQARWFALRASSLEASSAAVTVAVNGTAAAGAAVEKVQEDNEGLSVKEDQDERGLEVLYDDGFGSVTVKDYFAAAKVLCSRDDGGPPRWFSPVECGRPAVDDAPLLLFLPGMDGVGTGLILHHKSLGKVFEVRCLHIPVNDRTPFEGLVETVEKSIEHEHDLSPDRPIYLVGDSFGGSLAVAVAARNPQIDLVLILVNPATSFAKTPLQPVLPLLESMPSEFHVTVPYLLSFVMGDPLKMAAVSIENNLSPPETLQKLSDSLTSMLPLLSELSDIIPRDTLLWKLKLLKAGAAYANSRLHAVQAEVLLLASGKDNLLPSGEEADRLFKALKNCRVRYFKDNGHTLLLEDGVNLLSVIKGANMYRRGRQRDFVTNYLPPTLSEFKQTFDVDHKLFHLALSPVMMSTLKNGKVVRGLSGVPDKGPVLFVGYHALMGIELSPLYEEFLREKKTVVRGMAHPFLFGNKFDSSRQEISRIDTVSMYGGLPVTPINMYRLFKRNDFVLLYPGGVREALHRKGEEYKLFWPDQPEFVRMAARFDVTIIPFGCVGEDDVLELVLDYNDQKNIPGLREWIESINKEAERVRDSVKGEDGNQDMYLPALLPKVPGRFYYLFGQPIEMKGMNNLVRDRKRTNEVYLRIKSEVEEIMSYLKRKREEDPYRSIAQRALYQATWGASAQVPTFEP

SEQ ID NO: 15267 - protein, 701 aa, Setaria italica
MPVAALHPLPAVVGAGRRGFRRQARFGLRASSLESPSAAVTVLNGVAGAPVERMEKVKEDKADVPVVKDEDEKKGLDVLYDDGFGSVTVKDYFAAAKAVSRDDGGPPRWFCPVECGRPAVDDAPLLLFLPGTDGVGMGLILHHKSLGKVFEVRCLHIPINDRTPFEGLLQTVENTIEHEHDLSPNRPIYLVGDSFGGCLAVAVAARNPQIDLVLILVNPATSFARTPLQPILPLLESMPSEFHVTVPYLLSFVMGDPLKMASVSIENNLSPPETLQKLSDSLTSMLPLLSELADIIPRDTLLWKLKLLKTGAAYANSRLHAVQAEVLLLASGNDNLLPSGDEADRLFKALKNCRVRYFKDNGHTLLLEDGVNLLSVIKGVNMYRRRRQRDFVTDYLPPTLSEFKKTFDEDHKLFHLALSPVMMSTLKNGKIVRGLSGIPDQGPVLFVGYHALMGIELSPLYEEFLREKKTIVRGLAHPFLFGTKFESSRQELSRLDTVSMYGGLPVTPINMYRLFERNEFVLLYPGGVREALHRKGEEYKLFWPDQPEFVRMAARFGVTVIPFGCVGEDDVLELVLDYNDQKNIPGLREWIESVNKEADRVRDSVKGEDGNQDMYLPALLPKVPGRFYYLFGKPIEMKGMNSLVRDRKSANDVYLRIKSEVEEIMSYLKRKREEDPYRSIAQRALYQATWGTSGQVPTFEP

SEQ ID NO: 15268 - protein, 697 aa, Panicum virgatum
MPVAALHPLPAIVGAGRRRARRHRRFGLRASSLESPSVASTALDGVAGPPVERKEKVKDDAAAAEKEENKGLHALYDDGFGGVTVKDYFAAAKAVSRDDGGPPRWFCPVECGRPAVDGAPLLLFLPGTDGVGMGLILHHKSLGKVFEVRCLHIPVNDRTPFEGLLQTVENTIKHEHDLSPNRPIYLVGDSFGGCLAVAVAARNPQIDLLLILVNPATSFAKTPLQPILPLLESMPSEFHVTVPYLLSFVMGDPLKMASVSIENNLSPPETLQKLSDSLTSMLPLLSELPDIIPRDTLLWKLKLLKTGAAYANSRLHAVQAEVLLLASGSDNLLPSRDEADRLFKALKNCRVRYFKDNGHTLLLEDGVNLLSVIKGVNMYRRGRQRDFVTDYLPPTLSEFKKTFDEDHKLFHLALSPVMMSTLKNGKIVRSLSGIPDKGPVLFVGYHALMGIELSPLYEEFLREKKKIVRGLAHPLLFGTKFESSRQELSRLDTVSMYGGLPVTPINMYRLFERNEFVLLYPGGVREALHRKNEEYKLFWPDQPEFVRMAARFGVTVIPFGCVGEDDVLELVVDYNDQKNIPGLREWIESVNKETDRVRDSVKGEDGNQDMHLPAVLPKVPGRFYYLFGKPIEMKGMNNLVRDRKSANEVYLRIKSEVEEIMSYLKRKREEDPYRSIAQRALYQATWGVSAQVPTFEP

SEQ ID NO: 15269 - protein, 698 aa, Oryza sativa
MSAALHTLPAVAAGGLGCRWRRPSATLRAASSVGTASVAVSVNAETQQQRQVGVEEEEKRREDAAEVRTGRVVEALYDDGFGGVTVKDYFAAARAVSSDDGGPPRWFCPVDAGRPAVDNAPLLLFLPGTDGVGMGLILHHKSLGRVFEVRCLHIPVNDRTPFEGLLQIVENSIKYEHAMSPNRPIYLVGDSFGGCLALSVAARNPQIDLVLILINPATSFAKTPLQPILPVLEAMPSELHVTVPYLLSFVMGDPLKMAMVSVENNLSPPKTLQKLSDSLTSMLPLLSELADIIPRDTLFWKLKLLKSGAAYANSRLHAVQAEVLLLASGNDNLLPSGEEADRLFKSLKNCRVRYFKDNGHTLLLEDGVNLLSVIKGVNMYRRGRQRDPVTDYIPPTLSEFKKTFDEDHKLFHLALSPVMLSTLKNGKIVRGLTGVPDQGPVLFVGYHALMGIELSPLYEEFLREKRTSFRGMAHPILFGGKHESSRQELSRFDTISMYGGLPVTAINMYRLFERNQFVLLYPGGVREALHRKGEAYKLFWPDQPEFVRMAARFGVTIIPFGFVGEDDVLELVADYNDQKNIPYLREWIESINREAQRVRDSVKGEDGNQDVHIPALLPKVPGRFYYLFGKPIEMKGMDNVVRDRKSANEVYLHIKSEVESLMSYLKRKREEDPYRSIAQRAVYQASWGASAEVPTFEP

SEQ ID NO: 15270 - protein, 698 aa, Oryza sativa
MSAALHTLPAVAAGGLGCRWRRPSATLRAASSVGTASVAVSVNAETQQQRQVGVEEEEKRREDAAEVRTGRVVEALYDDGFGGVTVKDYFAAARAVSSDDGGPPRWFCPVDAGRPAVDNAPLLLFLPGTDGVGMGLILHHKSLGRVFEVRCLHIPVNDRTPFEGLLQIVENSIKYEHAMSPNRPIYLIGDSFGGCLALSVAARNPQIDLVLILINPATSFAKTPLQPILPVLEAMPSELHVTVPYLLSFVMGDPLKMAMVSVENNLSPPKTLQKLSDSLTSMLPLLSELADIIPRDTLFWKLKLLKSGAAYANSRLHAVQAEVLLLASGNDNLLPSGEEADRLFKSLKNCRVRYFKDNGHTLLLEDGVNLLSVIKGVNMYRRGRQRDPVTDYIPPTLSEFKKTFDEDHKLFHLALSPVMLSTLKNGKIVRGLTGVPDQGPVLFVGYHALMGIELSPLYEEFLREKRTSFRGMAHPILFGGKHESSRQELSRFDTISMYGGLPVTAINMYRLFERNQFVLLYPGGVREALHRKGEAYKLFWPDQPEFVRMAARFGVTIIPFGFVGEDDVLELVADYNDQKNIPYLREWIESINREAQRVRDSVKGEDGNQDVHIPALLPKVPGRFYYLFGKPIEMKGMDNVVRDRKSANEVYLHIKSEVESLMSYLKRKREEDPYRSIAQRAVYQASWGASAEVPTFEP

SEQ ID NO: 15271 - protein, 688 aa, Secale cereale
MSIPALRSFPAVYGVKPAARLVRHHSRLGGSLRASSVAVNGEVGLRNRGGKKEDAAKEEDRGLEPLYDDGFGGVTVKDYFAAARALCKDDGGPPRWFSPVECGKPAVEDAPLLLFLPGTDGVGMGLILHHKSLGKAFEVRCLHIPVNDRTPFEGLLQIVEQSIQYEHDLSPNRPIYLVGDSFGGCLALAAAARNPHIDLVLLLVNPATSFARTPLQPILPLLEAMPSDLHVTVPYLLSFVMADPLKMAMVSIENNLSPPETLQKLSESLTSLLPLLSQLADIIPRDALLWKLKLLKSGAAYANSRLHAVQAEVLFLASGKDNLLPSGEEADRLFKALKNCRVRYFKENGHTLLLEDGVNLLSVIKGANMYRRGRQRDFVTDYLPPTLSEFKKTFDEDHKLFHLALSPVMMSTLTNGKIVRGLAGVPDQGPVLFVGYHALMGIELSPLYEEFLREKNTIVRGMAHPVLFGSNYETSRQEFSRFDTVSMYGGLPVTPINMYRLFERNQYVLLYPGGVREALHRKGEEYKLFWPDQPEFVRMAARFGVTVVPFGFVGEDDILELVLDYNDQKNIPYLREWIESINKDSRRVRDSVKGEEGNQDMHIPAIVPKVPGRFYYLFGKPIKMEGMNNVLTDRESANEVYLHIKSEVENAMAYLQRKREEDPYRSIAQRAVYQATQGVSAQVPTFEP

SEQ ID NO: 15272 - protein, 689 aa, Triticum aestivum
MSIPALRSFPAVYGVKPTARLVRHHSRLGGGLRASSVAVNGEVGLRNRSGKKEDAVKEEKDRGLEPLYDDGFGGVTVKDYFAAARALCKDDGGPPRWFSPVECGQPAVEDAPLLLFLPGTDGVGMGLILHHKSLGKAFEVRCLHIPVNDRTPFEGLLQIVEKSIQYEHDLSPNRPIYLVGDSFGGCLALAAAARNPHIDLVLLLVNPATSFAKTPLQPILPLLEAMPSDLHVTVPYLLSFVMADPLKMAMVSIENNLSPPETLQKLSESLTSLLPLLSQLADIIPRDALLWKLKLLKSGAAYANSRLHAVQAEVLFLASGKDNLLPSGEEADRLFKALKNCRVRYFKENGHTLLLEDGVNLLSVIKGANMYRRGRQRDFVTDYLPPTLSEFKKTFDEDHKLFHLALSPVMMSTLTNGKIVRGLAGVPDQGPVLFVGYHALMGIELSPLYEEFLREKNTIVRGMAHPMLFGSKYETSRQESSRLDTVSMYGGLPVTPINMYRLFERNQYVLLYPGGAREALHRKGEEYKLFWPDQPEFVRMAARFGVTVVPFGFVGEDDILELVLDYNDQKNIPYLREWIESINKDGQRVRDSVKGEEGNQDMHIPAIVPKVPGRFYYLFGKPIKMEGMNNVLTDRESANEVYLHIKSEVENAMAYLQRKREEDPYRSIAQRAVYQATQGVSAQVPTFEP

SEQ ID NO: 15273 - protein, 859 aa, Sorghum bicolor
MASPAGGGSPAKPVLLHGDLDLWILEARLLPNMDMFSEHVRRCLAACRPPSSCGTKHPTAAARGPGGGRGGRHHHRKIITSDPYVTLSVSGAVVARTAVIPNSQDPVWEERFAVPLAHRAAELEFQVKDNDTFGAQAIGTVTVPAERVVSGDEVEDWFPVIGTNGKPYKPDTALRLRFKFQPIANNPAYRHGIAGDPDHRGIEDSYFPLRHGGQVTLYQDAHVREGDLPEIELDDGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKITAFIGGLDLCDGRYDTPEHRLFKDLDTVFQNDYHNPTFSAGAKGPRQPWHDLHCRIDGPAAYDVLLNFEQRWRKATKWRDRFRRVSHWKDDALIKLERISWILSPSPNVPNDHPSLWVSKEEDHEKWHVQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDMQLEDYLNFFCLGNREEPPSNGSPESEKSTDKSAAGLATKYRRFMIYVHAKGMIVDDEYVILGSANINQRSLAGSRDTEIAMGAYQPHYAWSTKNGHPHGQVYGYRTSLWAEHLGTVDDRFKDPSSLECVRRVNQIAVENWQRFTAEEMSTLQGHLLKYPVKVEADGKISSLPDQECFPDVGGKILGASTSLPDSLTM

SEQ ID NO: 15274 - protein, 857 aa, Sorghum bicolor
MASPAGGGSPAKPVLLHGDLDLWILEARLLPNMDMFSEHVRRCLAACRPPSSCGTKHPTAAARGPGGGRGGRHHHRKIITSDPYVTLSVSGAVVARTAVIPNSQDPVWEERFAVPLAHRAAELEFQVKDNDTFGAQAIGTVTVPAERVVSGDEVEDWFPVIGTNGKPYKPDTALRLRFKFQPIANNPAYRHGIAGDPDHRGIEDSYFPLRHGGQVTLYQDAHVREGDLPEIELDDGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKITAFIGGLDLCDGRYDTPEHRLFKDLDTVFQNDYHNPTFSAGAKGPRQPWHDLHCRIDGPAAYDVLLNFEQRWRKATKWRDRFRRVSHWKDDALIKLERISWILSPSPNVPNDHPSLWVSKEEDHEKWHVQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQTMEMMYKIIADELKAMDIKDMQLEDYLNFFCLGNREEPPSNGSPESEKSTDKSAAGLATKYRRFMIYVHAKGMIVDDEYVILGSANINQRSLAGSRDTEIAMGAYQPHYAWSTKNGHPHGQVYGYRTSLWAEHLGTVDDRFKDPSSLECVRRVNQIAVENWQRFTAEEMSTLQGHLLKYPVKVEADGKISSLPDQECFPDVGGKILGASTSLPDSLTM

SEQ ID NO: 15275 - protein, 856 aa, Zea mays
MASPAGGESPAKPVLLHGDLDLWILEARLLPNMDMFSEQVRRCLAVCRPPTSCGTNHPPAAARGGGGRQHHHRKIITRGPYVTLSVSGAVVARTAVIPNSQDPVWEERFAVPLAHRAAELEFQVKDNDTFGAQLIGTVTVPADCVVSGTEAEDWFPVKGTNGKPYKPDTALRLRFTFHPIANNPAYRHGIPGDPGHRGIGESYYPLRHGGQVTLYQDAHIREGDLPEIELDDGKTFQHNSCWEDICHAILEAHHMIYIVGWSVYDKVRLVREPSPSRPLPDGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKVTAFIGGLDLCDGRYDTPKHRLFKDLDTVFQNDYHNPTFSSGAKGPRQPWHDLHCRIDGPAAYDVLTNFEQRWRKATKWRGRFRRVSHWKDDALIKLERISWIISPSPNVPNDHPSLWVSKEEDRENWHVQVFRSIDSGSLKGFPSDCKEASKLNLVCRKNLVIDKSIHTAYVRAIRSAQHFIYIENQYFLGSSYAWPSYVNSGADNLIPIELALKIASKIRAQERFAVYVVIPMWPEGVPTAASVQEILFFQAQTMEMMYTIIADELKSMDNKDMRPEDYLSFFCLGNREEPPSNGSPESEKSTDKSAVGLATKYRRFMIYVHAKGMIVDDEYVILGSANINQRSLAGSRDTEIAMGAYQPHYAWSTKNGHPDGQVYGYRTSLWAEHLGTIDDRFKDPSSLECVRFVNQIAVENWRRYTAEEMSTLQGHLLKYPVKVEADGKISPLPDQECFPDVGGKILGASTSLPDSLTM

SEQ ID NO: 15276 - protein, 861 aa, Setaria italica
MASSAGGESPAKPKTVLLHGDLDLWIKEARLLPNMDLFSEQVRRCFAACRPPTSCGPKHPPAAAVPRGGSGGRHHHHRKIITSDPYVTLSVSGAVVARTAVIPNNQDPVWEERFAVPLAHRAAALEFQVKDNDTFGAQLIGTVTVPADIVASGEEVEDWYPIIGTNGKPYKPDTALCLRFRFQPIAENPAYRRGIPGDPERKGIKDSYFPLRHGGQVTLYQDAHVREGDLPEIELEDGKMFEHNACWEDICHAILEAHHMIYIVGWSVYDKVRLVRERSPSRPLPEGGDLTLGELLKFKSQEGVRVCLLVWDDKTSHDKFLFKTGGVMATHDEDTRKFFKHSSVICVLSPRYASNKLSIFKQQVVGTLFTHHQKCVLVDTQAWGNKRKVTAFIGGLDLCDGRYDTPEHRLFKDLDTVFHNDYHNPTFSAGAKGPRQPWHDLHCRIDGPAAYDVLTNFEQRWRKATKWRDRFRRVSHWKDDALIKLERISWILSPSRNVPNDHPSLWVSKEEDRENWHVQVFRSIDSGSLKGFPSDCKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDMHPQDYLNFFCLGNREEPSSNGSPESEKSTDKSAAALATKYRRFMIYVHAKGMIVDDEYVILGSANINQRSLAGSRDTEIAMGAYQPHHAWSTKNRHPHGQVYGYRTSLWAEHLGMVDDRFKDPSSLDCVRFVNQIAVENWQRFTAEEIRTLQGHLLKYPVNVEDDGKIGPLPDQENFPDVGGKILGAPTSLPDSLTM

SEQ ID NO: 15277 - protein, 857 aa, Panicum virgatum
MASSAGGESPAKPVLLHGDLDLWILEARLLPNMDLFSEQVRRCFAACRPPTSCGPKQPPPAARGASGGARQHHRKIITSDPYVTLSVSGAVVARTAVIPNCQEPVWEERFAVPLAHRAAALEFQVKDNDTFGAQLIGTVTVPADLVARGEEVEDWYPVIGTNGKPYKPDTALRLRFRFQHIAENPAYRHGIPGDPEHSGIKDSYFPLRHGGQVTLYQDAHVKEGDLPEIELENGKMFEHNACWEDICHAILEAHHMIYIVGWSVYDKVRLVRERSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQAWGNKRKVTAFIGGLDLCDGRYDTPEHRLFKDLDTVFENDYHNPTFSAGAKGPRQPWHDLHCRIDGPAAYDVLKNFEQRWRKATKWRDRFRSVSHWKDDALIKLERISWILSPSRNVPNDHPTLWVSKEDDPENWHVQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDLHPQDYLNFFCLGNREEPTSNGILESEKSSDKSAAALATKYRRFMIYVHAKGMIVDDEYVILGSANINQRSLAGSRDTEIAMGAYQPHYAWSTKNRHPHGQVYGYRTSLWAEHLGMVDDRFKDPTSLDCVRFVNQIAEENWQRFTAEEMRTLQGHLLKYPVKVEDDGKIVSLPDQECFPDVGGKILGAPTSLPDSLTM

SEQ ID NO: 15278 - protein, 841 aa, Panicum virgatum
LEARLLPNMDLFSEQVRRCFAACRPPTSCGPKQPLPTTAATRGASAAGGGGGARQHHRKIITSDPYVTLSVADAVVARTAVIPNCQEPVWEERFAVPLAHRAAALEFQVKDNDTFGAQLIGTVTVPADLVARGEEVEDWYPIIGTNGKPYKPDTALRLRFRFQPIAENPAYRHGIPGDPDHSGIKDSYFPLRHGGQVTLYQDAHVREGDLPEIELENGKMFEHNACWEDICHAILEAHHMIYIVGWSVYDKVRLVRERSPSWPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQAWGNKRKVAAFIGGLDLCDGRYDTPEHRLFKDLDTAFENDYHNPTFSAGAKGPRQPWHDLHCRIDGPAAYDVLKNFEQRWRKATKWRDRFRTVSHWKDDALIKLERISWILSPSPNIPNDHPTLWVSKEEDPENWHVQVFRSIDSGSLKGFPSDSKEASKQNLVCRKNLIIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDLHPQDYLNFFCLGNREEPTSNGSLESEKSTDKSAAALATKYRRFMIYVHAKGMIVDDEYVILGSANINQRSLAGSRDTEIAMGAYQPHYAWSTKNRHPHGQVYGYRTSLWAEHLGMVDDRFKDPSSLDCVRFVNQIAEENWQRFTAEEMRTLQGHLLKYPVKVEADGKIGSLPDQECFPDVGGKILGAPTSLPDSLTM

SEQ ID NO: 15279 - protein, 854 aa, Oryza sativa
MESSAGGGGGESPPPAKPVLLHGDLDLWVVEARLLPNMDMFSEHVRRCFAACKPPTSCATARQPRHARGHHRRKIITSDPYVTLSVAGAVVARTRVIPNDQDPVWDERFAVPLAHYAAALEFHVKDNDTFGAQLIGTVTIPADRVASCQEVEDWFPIIGNNGRPYKPDTALRLRLRFNPAADNPLYRRGIPGDPDHQGIKDSYFPLRHGGRVTLYQDAHYREGDLPEIELDEGGKVFDHNACWEDICHAILEAHHMIYIVGWSVYDKVRLVREPSPSRPLPEGGDLNLGELLKFKSQEGVRVCLLVWDDKTSHDKLFIKTGGVMATHDEETRKFFKHSSVICVLSPRYASSKLSIFKQQVVGTLFTHHQKCVLVDTQAWGNKRKITAFIGGLDLCDGRYDTPEHRLFKDLDTVFDNDYHNPTFPSGAKGGPRQPWHDLHCRIDGPAAYDVLKNFEQRWRKATKWRERFRKVSHWKDDALIKLERISWILSPSPTIPNDDISLRVSKEEDPENWHVQVFRSIDSGSLKGFPSDCKEASKQNLICRKDLIIDKSIHTAYVRAIRSAQHFIYIENQYFLGSSYAWPSYVNSGADNLVPIELALKIASKIRAGERFAVYVVIPMWPEGVPTAASVQEILFFQTMEMMYRIIAQELKAMNIKNAHPQDYLNFYCLGNREESSSSNGSPESNDKSAAALARKYRRFMIYVHAKGMIVDDEYVILGSANINQRSLAGSRDTEIAMGAYQPHHTWSTKGGHPRGQVYGYRTSLWAEHLGMVDDLFKDPSSLECVNYVNEIAEENWRRFTAEQLITLQGHLLKYPVKVEADGKVGPLPEHECFPDVGGKILGAPTSLPDTLTM

SEQ ID NO: 15280 - protein, 858 aa, Brachypodium distachyon
MASPADGESPAKPILLHGDLDLWIIEARLLPNMDMFSEHIRRCFATCGTASSCAPKQPPRTRGGEGPNRRHHRKIITSDPYVTLSVAGAVVARTAVIPNSEEPRWGEQFFVPLAHRAAMLEFQVKDNDTFGAQLIGTASIPADRVTSACEEEVDEWFPIVGPSGRPYKPRTALHLRFRFRPLDTNPMYKHGIPGDPEKQGVQDSYFPLRHGGRVTLYQDAHVNEGDLPGIELERGKQFEHNNCWEDICHAILEAHHMIYIVGWSVYDKVKLVREPSPSRPLPEGGDLTLGDLLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFVGGLDLCDGRYDTPQHRLFKDLDTVFENDYHNPTFSAGAKGPRQPWHDLHCKIDGPAAYDVLKNFEQRWRKASKFRERFRKISHWKDDALIKLERISWILSPSPNIPNDHASLRVSKEEDPENWHVQVFRSIDSGSLKGFPSDCKEASKQNLVCRKNLIIDKSIHTAYVRAIRSAQHFIYIENQYFLGSSYGWPSYVNSGADNLIPMELALKIASKIRAGERFAVYVVIPMWPEGVPTAASVQEILYFQAQTMEMMYRVVAQELKTMNIENAHPQDYLNFYCLGNREESSTNGSPESDKSTDKSAAALARKYRRFMIYVHAKGMIVDDEYVILGSANINQRSLAGSRDTEIAMGAYQPHHSWSKKGAHPHGQVYGYRSSLWAEHLGMVDDRFKDPSSLDCVRFVNQIAEENWNRFTAEEMKTLQGHLLRYPVKVEPDGNIGPLPDQECFPDVGGKICGAPTSLPDSLTM

SEQ ID NO: 15281 - protein, 1958 aa, Glycine max
MSSSRGGAGPSSEAPPPRRIMRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMRFPEIQAAVYALRNTRGLPWPKDFKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEDEAFLRKVVTPIYNVIAKEAARSKKGRSKHSQWRNYDDLNEYFWSADCFRLGWPMRADADFFCLPAEKLVFDKSNDDKPPSRDRWVGKVNFVEIRSFWHMFRSFDRMWSFFILCLQAMIVVAWNGSGDPSAIFNGDVFKKVLSVFITAAILKFGQAVLDVILSWKAQWSMSLYVKLRYILKVVSAAAWVIVLSVTYAYTWDNPPGFAQTIKSWFGSGGSSAPSLFILAVVVYLSPNMLAAIFFLIPFIRRHLERSNYRIVMLMMWWSQPRLYVGRGMHESAFSLFKYTMFWVLLIITKLAFSYYIEIKPLVGPTKAIMSVKITTFQWHEFFPHARNNIGVVIALWAPIILVYFMDTQIWYAIFSTLFGGIYGAFRRLGEIRTLGMLRSRFQSLPGAFNASLIPEETNEPKKKGLKATLSRRFPEISSNKGKEAARFAQLWNQIITSFRDEDLINDREMNLLLVPYWADTQLDLIQWPPFLLASKIPIALDMAKDSNGKDRELKKRIAADNYMSCAVRECYASFKSIIKHLVQGEREIPVIEYMFDEVDKNIETDKLISEFRMSALPSLYAQFVELTQYLLNNDPKDRDNVVILFQDMLEVVTRDIMMEDQDQIFSLVDSSHGGTGHEGMLHLEPEPHHQLFASEGAIKFPIEPLTAAWTEKIKRLHLLLTTKESAMDVPSNLEARRRISFFSNSLFMDMPMAPKVRNMLSFSVLTPYYTEEVLFSLHDLDSQNEDGVSILFYLQKIYPDEWNNFLERVKSTEEDIKGSEFDELVEERRLWASYRGQTLTRTVRGMMYYRKALELQAFLDMAKDEDLMEGYKAMENSDDNSRGERSLWTQCQAVADMKFTYVVSCQQYGIDKRSGSLRAQDILRLMTRYPSLRVAYIDEVEEPVQDSKKKINKVYYSCLVKAMPKSNSPSEPEQNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYVFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLVVYEIFGHSYRSTVAYILITASMWFMVGTWLFAPFLFNPSGFEWQKIVDDWTDWNKWISNRGGIGVLPEKSWESWWEEEQEHLQYSGMRGIIVEILLSLRFFIYQYGLVYHLNITKKGTKSFLVYGISWLVIFVILFVMKTVSVGRRKFSANFQLVFRLIKGMIFLTFVSILVILIALPHMTVQDIVVCILAFMPTGWGMLQIAQALKPVVRRAGFWGSVKTLARGYEIVMGLLLFTPVAFLAWFPFVSEFQTRMLFNQAFSRGLQISRILGGQRKERSSRNKE

SEQ ID NO: 15282 - protein, 1958 aa, Glycine max
MSSSRGGAGPSSEAPPPRRIMRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMRFPEIQAAVYALRNTRGLPWPKDYKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLRKVVTPIYNVIAKEAARSKKGRSKHSQWRNYDDLNEYFWSADCFRVGWPMRADADFFCLPAEKLVFDKSNDDKPPSRDRWVGKVNFVEIRSFWHMFRSFDRMWSFFILCLQAMIIVAWNGSGDPSAIFNGDVFKKALSVFITAAILKFGQAVLDVILSWKAQQSMSLYVKLRYILKVVSAAAWVIVLSVTYAYTWDNPPGFAQTIKSWFGSGGSSSPSLFILAVVVYLSPNMLAAIFFLIPFIRRHLERSNYRIVMLMMWWSQPRLYVGRGMHESAFSLFKYTMFWILLIITKLAFSYYIEIKPLVGPTKAIMSVKITIFQWHEFFPHARNNIGVVIALWAPIILVYFMDTQIWYAIFSTLFGGVYGAFRRLGEIRTLGMLRSRFQSLPGAFNASLIPEETNEPKKKGLKATLSRRFPEISSNKGKEAARFAQLWNQIITSFRDEDLIDDREMNLLLVPYWADTQLDLIQWPPFLLASKIPIALDMAKDSNGKDRELKKRIAADNYMSCAVRECYASFKSIIKHLVQGEREIPVIEYMFNEVDKHIESDKLISEFKMSALPILYGQFVELIQYLLTNDPKDRDRVVLLFQDMLEVVTRDIMMEDQDQIFSLVDSSHGGTGHEGMLHLEPEPHHQLFASEGAIKFPIEPLTAAWTEKIKRLHLLLTTKESAMDVPSNLEARRRISFFSNSLFMDMPMAPKVRNMLSFSVLTPYYTEEVLFSLNDLDSQNEDGVSILFYLQKIFPDEWNNFLERVNSTEEDIKGSESDELVEELRLWASYKGQTLTRTVRGMMYYRKALELQAFLDMAKDEDLMEGYKAMENSDDNSRGERSLWTQCQAVADMKFTYVVSCQQYGIDKRSGSPRAQDILRLMTRYPSLRVAYIDEVEEPVKDSKKKINKVYYSCLVKAMPKSNIPSEPERNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYVFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLVVYQIFGHSYRSTVAYILITASMWFMVGTWLFAPFLFNPSGFEWQKIVDDWTDWNKWISNRGGIGVPPEKSWESWWEEEQEHLQYSGMRGIIVEILLSLRFFIYQYGLVYHLNITKKGPKSFLVYGISWLVIFVILFVMKTVSVGRRKFSANFQLVFRLIKGMIFLTFVSILVILIALPHMTVLDIVVCILAFMPTGWGMLQIAQALKPVVRRAGFWGSVKTLARGYEIVMGLLLFTPVAFLAWFPFVSEFQTRMLFNQAFSRGLQISRILGGQRKERSSRNKE

SEQ ID NO: 15283 - protein, 1958 aa, Glycine max
MSSSRGGAGPSSEAPPPRRIMRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMRFPEIQAAVYALRNTRGLPWPKDYKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLRKVVTPIYNVIAKEAARSKKGRSKHSQWRNYDDLNEYFWSADCFRVGWPMRADADFFCLPAEKLVFDKSNDDKPPSRDRWVGKVNFVEIRSFWHMFRSFDRMWSFFILCLQAMIIVAWNGSGDPSAIFNGDVFKKALSVFITAAILKFGQAVLDVILSWKAQQSMSLYVKLRYILKVVSAAAWVIVLSVTYAYTWDNPPGFAQTIKSWFGSGGSSSPSLFILAVVVYLSPNMLAAIFFLIPFIRRHLERSNYRIVMLMMWWSQPRLYVGRGMHESTFSLFKYTMFWILLIITKLAFSYYIEIKPLVGPTKAIMSVKITIFQWHEFFPHARNNIGVVIALWAPIILVYFMDTQIWYAIFSTLFGGVYGAFRRLGEIRTLGMLRSRFQSLPGAFNASLIPEETNEPKKKGLKATLSRRFPEISSNKGKEAARFAQLWNQIITSFRDEDLIDDREMNLLLVPYWADTQLDLIQWPPFLLASKIPIALDMAKDSNGKDRELKKRIAADNYMSCAVRECYASFKSIIKHLVQGEREIPVIEYMFNEVDKHIESDKLISEFKMSALPILYGQFVELIQYLLTNDPKDRDRVVLLFQDMLEVVTRDIMMEDQDQIFSLVDSSHGGTGHEGMLHLEPEPHHQLFASEGAIKFPIEPLTAAWTEKIKRLHLLLTTKESAMDVPSNLEARRRISFFSNSLFMDMPMAPKVRNMLSFSVLTPYYTEEVLFSLNDLDSQNEDGVSILFYLQKIFPDEWNNFLERVNSTEEDIKGSESDELVEELRLWASYKGQTLTRTVRGMMYYRKALELQAFLDMAKDEDLMEGYKAMENSDDNSRGERSLWTQCQAVADMKFTYVVSCQQYGIDKRSGSPRAQDILRLMTRYPSLRVAYIDEVEEPVKDSKKKINKVYYSCLVKAMPKSNIPSEPERNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYVFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLVVYQIFGHSYRSTVAYILITASMWFMVGTWLFAPFLFNPSGFEWQKIVDDWTDWNKWISNRGGIGVPPEKSWESWWEEEQEHLQYSGMRGIIVEILLSLRFFIYQYGLVYHLNITKKGPKSFLVYGISWLVIFVILFVMKTVSVGRRKFSANFQLVFRLIKGMIFLTFVSILVILIALPHMTVLDIVVCILAFMPTGWGMLQIAQALKPVVRRAGFWGSVKTLARGYEIVMGLLLFTPVAFLAWFPFVSEFQTRMLFNQAFSRGLQISRILGGQRKERSSRNKE

SEQ ID NO: 15284 - protein, 1957 aa, Cicer arietinum
MSSSSRGAGPSEPPQRRIIRTQTAGNLGESIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPYNILPLDPDSANQAIMRFPEIQAAVFALRNTRGLLWPKDYKKKKDEDILDWLGSMFGFQKHNVANQREHLILLLANVHIRQFPKPDQQPKLDERALTEVMKKLFKNYKKWCKYLDRKSSLWLPTIQQEVQQRKLLYMGLYLLIWGEAANLRFMPECLCYIYHHMAFELYGMLAGNVSPMTGENIKPAYGGEEEAFLRKVVTPIYNVIAEEAKKSKKGRSKHSQWRNYDDLNEYFWSADCFRLGWPMRADADFFSLPSERVVFDKSNDDKPANRDRWVGKVNFVEIRSFWHLFRSFDRMWSFFILSLQAMIIVAWNGSGDPTVIFNGDVFKKVLSVFITAAILKLGQAVLDVIVSWKARQSMSLYVKLRYILKVVSAAAWVIVLSVTYAYTWDNPPGFAQTIKSWFGSSSSAPSLFILAVVVYLSPNMLAAIFFLFPFIRRYLERSNYRIVMLMMWWSQPRLYVGRGMHESTFSLFKYTMFWFLLIVTKLAFSYYIEIKPLVGPTKAIMSVKITTFQWHEFFPHARNNIGVVVALWAPIMLVYFMDTQIWYAIFSTLFGGIYGAFRRLGEIRTLGMLRSRFQTLPGAFNASLIPEETTDEPRKKGLKATLSRRFTEVPSNKGKKAARFAQLWNQIITSFREEDLISDREMDLLLVPYWADTQLDLIQWPPFLLASKIPIALDMAKDSNGKDRELTKIIEADNYMFCAVRECYASFKSIMMQLVRGEREKPVIEFMFSEVDKHIAEGTLIKEFKMSALPSLYEQFVQLIKYLLENNQKDRDQVVILFQDMLEVMTRDIMMEDQDQIFRLVDSNHGGAGHEGMFPLEPEPQHQLFASEGAIRFPIEPVTAAWTEKIKRLFLLLTTKESAMDVPSNLEARRRISFFSNSLFMDMPLAPKVRNMLSFSVLTPYYTEEVLFSLHNLDSPNEDGVSILFYLQKIFPDEWNNFLQRVKCSSEEELKGNEYEELEEELRLWASYRGQTLTRTVRGMMYYRKALELQAFLDMAKDEDLMEGYKAMENLDDNSRGEKSLLTQCQAVADMKFTYVVSCQQYGIDKRSGSLRAHDILRLMTRYPSLRVAYIDEVEEPIKDTKKKINKVYYSCLVKAMPKSSSPSEPEQNLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLRVRFHYGHPDVFDRLFHLTRGGVSKASKVINLSEDIFAGFNSTLREGSVTHHEYIQVGKGRDVGLNQISMFEAKIANGNGEQTLSRDVYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYFGRTLLHGGAKYRSTGRGFVVFHAKFADNYRLYSRSHFVKGIELMILLVIYQIFGHSYRGAVAYVLITVSMWFMVGTWLFAPFLFNPSGFEWQKIVDDWTDWNKWISNRGGIGVLPEKSWESWWEEEQDHLQYSGIRGIIVEILLSLRFFIYQYGLVYHLNITKKGSKSFLVYGISWLVIFVILFVMKTVSVGRRKFSANFQLVFRLIKGMIFVTFVSILVILIALPHMTLQDIVVCVLAFMPTGWGILQIAQALKPIVRRAGFWGSVKTLARGYEIVMGLLLFTPVAFLAWFPFVSEFQTRMLFNQAFSRGLQISRILGGQRKERSSRNKE

SEQ ID NO: 15285 - protein, 1960 aa, Arachis hypogaea
MSSRGAGPSSEAPQRRIMRTQTAGNLGESIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPYNVLPLDPDSANQAIMRFPEIQAAVYALRNIRGLPWPKDYKKKKEEDILDWLGAMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLKKVVTPIYDVIRQEAARSKKGRSKHSQWRNYDDLNEYFWSADCFRLGWPMRADADFFWVPSNEQSSFDKSNDEKPTNPDRWVGKVNFVEIRSFWHIFRSYDRMWSFFILCLQAMIIVAWNKSGDPIAIFNGDVFKKVLSVFITAAILKFGQAFLDVVLSWKAQRSMSLFVKLRYILKVVSAAAWVIVLSVTYAYTWDNPPGFAQTIKRWFGNDSSFPSLFILAVVIYLSPNMLAAVFFLFPFIRRFLERSNYKIVMLMMWWSQPRLYVGRGMHESTFSLFKYTVFWVLLIITKLAFSYYIEIKPLVGPTKAIMGVRITTFQWHEFFPHARNNIGVVVALWAPIILVYFMDTQIWYAIFSTLFGGIYGAFRRLGEIRTLGMLRSRFQSLPGAFNASLIPEEKNEPRKKGLKATLSRRFAEIPSNRGKEAARFAQLWNQIITSFREEDLISNREMDLLLVPYWADRELDLIQWPPFLLASKIPIALDMAKDSNGKDRELKKRIDADHYMSCAVRECYASFKSIIKHLVQGEREKPVIDYLFTEVDSHIEDGKLITEFRMSALPSLYAQFVQLIKYLLDNDKKDRDQVVILFQDMLEVVTRDIMREEQDNVFSLVDSSHGGTGHEGTLPLNLEPEPQHQLFASEGAIRFPIEPLSEAWKEKINRLYLLLTTKESAMDVPSNLEARRRISFFSNSLFMDMPMAPKVRNMLSFSVLTPYYTEEVLFSLTDLDSPNEDGVSILFYLQKIFPDEWTNFLERVNTSEEDLKGNESEELEEELRRWASYRGQTLTRTVRGMMYYRKALELQAFLDMAKDEDLMEGYKAIENSDDNSSGERSLLTQCQAVADMKFTYVVSCQQYGIDKRSGSPRAQDILRLMTRYPSLRVAYIDEVEETSKDRDNRQKKINKVYYSCLVKAMPKSSSPSEPEQALDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYFGRTLLHGGAKYRPTGRGFVVFHAKFADNYRLYSRSHFVKGIELMILLIVYEIFGQSYRSAVAYILITISMWFMVGTWLFAPFLFNPSGFEWQKIVDDWTDWNKWISNRGGIGVPPEKSWESWWEEEQEHLQHSGLRGIIVEILLSLRFFIYQYGLVYHLNITKRNPKSFLVYGISWLVIFVILFVMKTVSVGRRKFSANFQLVFRLIKGLIFLTFVSILVTLIALPHMTMQDIVVCILAFMPTGWGLLQIAQALKPVVRRAGFWGSVKTLARGYEIVMGLLLFTPVAFLAWFPFVSEFQTRMLFNQAFSRGLQISRILGGQRKERSSRNKE

SEQ ID NO: 15286 - protein, 1958 aa, Medicago truncatula
MSSSSSRGPTPSEPPPRRLVRTQTAGNLGESIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPFNILPLDPDSANQAIMKFPEIQAAVYALRNTRGLPWPNDYKKKKDEDILDWLGSMFGFQKHNVANQREHLILLLANVHIRQFPNPDQQPKLDECALTEVMKKLFKNYKKWCKYLDRKSSLWLPTIQQEVQQRKLLYMGLYLLIWGEAANLRFMPECLCYIYHHMAFELYGMLAGNVSPMTGENIKPAYGGEDEAFLRKVVTPIYNVIAEEAKKSKRGRSKHSQWRNYDDLNEYFWSADCFRLGWPMRADADFFCLPAERVVFDKSNDDKPPNRDGWFGKVNFVEIRSFWHLFRSFDRMWSFFILCLQAMIIVAWNGSGDPTVIFHGDVFKKVLSVFITAAILKFGQAVLGVILSWKARRSMSLYVKLRYILKVISAAAWVILLSVTYAYTWDNPPGFAETIKSWFGSNSSAPSLFIVAVVVYLSPNMLAAIFFMFPFIRRYLERSNYRIVMLMMWWSQPRLYVGRGMHESTFSLFKYTVFWVLLLFTKLAFSYYIEIKPLVGPTKAIMKVKISTFQWHEFFPHARNNIGVVVVLWAPIILVYFMDTQIWYAIFSTLFGGIYGAFRRLGEIRTLGMLRSRFQSLPGAFNASLIPEESTDEPRKKGLKATLSRRFTEIPSNKGKKAARFAQLWNQIITSFREEDLINDSEMDLLLVPYWADTQLDLIQWPPFLLASKIPIALDMAKDSNGKDRELTKRIEADNYMSCAVRECYASFKSIIMHLVRGEREKPFIEYMFGEVDSHIEAGTLIKEFRMSALPSLYGQFVQLIQYLLVNNQKDRDQVVILFQDMLEVVTRDIMMEDQDQIFSLIDSSHGGVGHEGMFPLEPEPHHQLFASEGAISFPIEPVTAAWTEKIKRLFLLLTTKESAMDVPSNLEARRRISFFSNSLFMDMPVAPKVRNMLSFSILTPYYTEEVLFSLLDLDSPNEDGVSILFYLQKIFPDEWTNFLQRVKCSSEEELKGNESEELEEELRLWASYRGQTLTRTVRGMMYYRKALELQAFLDMAKDEDLMEGYKAMENSDDNSRGERSLWTQCQAVADMKFTYVVSCQQYGIDKRSGSPRAHDILRLMTRYPSLRVAYIDEVEEPIKNSKKKINKVYYSCLVKAMPKSSSSSEPEQNLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLRVRFHYGHPDVFDRLFHLTRGGVSKASKVINLSEDIFAGFNSTLREGSVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSAQKAIRDNKPLQVALASQSFVQIGFLMALPMLMEIGLERGFRTALSEFILMQLQLAPVFFTFSLGTKTHYFGRTLLHGGAKYRPTGRGFVVFHAKFADNYRLYSRSHFVKGIELLVLLVVYEIFSHSYRSAVAYILITVSMWFMVGTWLFAPFLFNPSGFEWQKIVDDWTDWNKWISNRGGIGVPPEKSWESWWEEEQDHLQYSGIRGIIVEILLSLRFFIYQYGLVYHLNITKKGSKSFLVYGISWLVIFVILFVMKTVSVGRRKFSANFQLVFRLIKGMIFVTFIAILVILIALPHMTPQDIIVCILAFMPTGWGMLQIAQALKPIVRRAGFWGSVKTLARGYEIVMGLLLFTPVAFLAWFPFVSEFQTRMLFNQAFSRGLQISRILGGQRKERASRSKE

SEQ ID NO: 15287 - protein, 1959 aa, Medicago truncatula
MSSSSSRGPTPSEPPPRRLVRTQTAGNLGESIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPFNILPLDPDSANQAIMKFPEIQAAVYALRNTRGLPWPNDYKKKKDEDILDWLGSMFGFQKHNVANQREHLILLLANVHIRQFPNPDQQPKLDECALTEVMKKLFKNYKKWCKYLDRKSSLWLPTIQQEVQQRKLLYMGLYLLIWGEAANLRFMPECLCYIYHHMAFELYGMLAGNVSPMTGENIKPAYGGEDEAFLRKVVTPIYNVIAEEAKKSKRGRSKHSQWRNYDDLNEYFWSADCFRLGWPMRADADFFCLPAERVVFDKSNDDKPPNRDGWFGKVNFVEIRSFWHLFRSFDRMWSFFILCLQAMIIVAWNGSGDPTVIFHGDVFKKVLSVFITAAILKFGQAVLGVILSWKARRSMSLYVKLRYILKVISAAAWVILLSVTYAYTWDNPPGFAETIKSWFGSNSSAPSLFIVAVVVYLSPNMLAAIFFMFPFIRRYLERSNYRIVMLMMWWSQPRLYVGRGMHESTFSLFKYTVFWVLLLFTKLAFSYYIEIKPLVGPTKAIMKVKISTFQWHEFFPHGTRNNIGVVVVLWAPIILVYFMDTQIWYAIFSTLFGGIYGAFRRLGEIRTLGMLRSRFQSLPGAFNASLIPEESTDEPRKKGLKATLSRRFTEIPSNKGKKAARFAQLWNQIITSFREEDLINDSEMDLLLVPYWADTQLDLIQWPPFLLASKIPIALDMAKDSNGKDRELTKRIEADNYMSCAVRECYASFKSIIMHLVRGEREKPFIEYMFGEVDSHIEAGTLIKEFRMSALPSLYGQFVQLIQYLLVNNQKDRDQVVILFQDMLEVVTRDIMMEDQDQIFSLIDSSHGGVGHEGMFPLEPEPHHQLFASEGAISFPIEPVTAAWTEKIKRLFLLLTTKESAMDVPSNLEARRRISFFSNSLFMDMPVAPKVRNMLSFSILTPYYTEEVLFSLLDLDSPNEDGVSILFYLQKIFPDEWTNFLQRVKCSSEEELKGNESEELEEELRLWASYRGQTLTRTVRGMMYYRKALELQAFLDMAKDEDLMEGYKAMENSDDNSRGERSLWTQCQAVADMKFTYVVSCQQYGIDKRSGSPRAHDILRLMTRYPSLRVAYIDEVEEPIKNSKKKINKVYYSCLVKAMPKSSSSSEPEQNLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLRVRFHYGHPDVFDRLFHLTRGGVSKASKVINLSEDIFAGFNSTLREGSVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSAQKAIRDNKPLQVALASQSFVQIGFLMALPMLMEIGLERGFRTALSEFILMQLQLAPVFFTFSLGTKTHYFGRTLLHGGAKYRPTGRGFVVFHAKFADNYRLYSRSHFVKGIELLVLLVVYEIFSHSYRSAVAYILITVSMWFMVGTWLFAPFLFNPSGFEWQKIVDDWTDWNKWISNRGGIGVPPEKSWESWWEEEQDHLQYSGIRGIIVEILLSLRFFIYQYGLVYHLNITKKGSKSFLVYGISWLVIFVILFVMKTVSVGRRKFSANFQLVFRLIKGMIFVTFIAILVILIALPHMTPQDIIVCILAFMPTGWGMLQIAQALKPIVRRAGFWGSVKTLARGYEIVMGLLLFTPVAFLAWFPFVSEFQTRMLFNQAFSRGLQISRILGGQRKERASRSKE

SEQ ID NO: 15288 - protein, 1954 aa, Lupinus angustifolius
MSSSTSPSQQQPVAARRLMRTQTAGNLGESIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAAKTEILVPYNILPLDPDSANQAIMRFPEIQAAVYALRNTRGLPLPKDYKKKKDEDILDWLGSMFGFQKHNVANQREHLILLLANVHIRQFPKPDQQPKLDDRALTEVMKKLFKNYKKWCKYLGRRSSLWLPTIQQEVQQRKLLYMGLYLLIWGEAANLRFMPECLCYIYHHMAFELYGMLAGNVSPMTGENVKPAYGGEEEAFLRKVVTPIYDVIAKEAGRSKKGRSKHSQWRNYDDLNEYFWSADCFRLGWPMRADADFFCLPVEHLFFDKSNDDKPANKDRWVGKVNFVEIRSFWHIFRSFDRMWSFFILCLQAMIIIAWNGSGNPLAIFNGDVFKKVLSVFITAAILKLGQAFLDVILSWKAQRSMSLYVKLRYILKVVSAAAWVIVLSVTYAYTWDNPPGFAQKIKSLFGNNSSVPSLFILAVAVYLSPNMLAALLFLFPLVRRLLERSNYRVVMLMMWWSQPRLYVGRGMHESTFSLVKYTFFWALLIFTKLAFSYYIEIKPLVQPTKAIMSVRISTFQWHEFFPHARNNLGVVVALWAPIILVYFMDCQIWYAIFSTLFGGIYGAFRRLGEIRTLGMLRSRFQSLPGAFNACLIPEEKNEPRKKGLKATLSRRFDQIPSNKGKEAARFAQLWNQIITSFREEDLISNREMELLLVPYWADSELDLIQWPPFLLASKIPIALDMAKDSNGKDRELKKRIEADNYMSCAVHECYASFKSIMKHLVQGEREKPVIDYMFAEVDRHIDASSLISEFRMSALPSLYKQFVQLIKYLLENDQKDRDQVVILFQDMLEVVTRDIMMEDQDHIFNLVDSIHGGAGHEGMLPLETEAHHQLFASEGAIKFPIEPLTAAWTEKIKRLFLLLTTKESAMDVPSNLEARRRISFFSNSLFMDMPLAPKVRNMLSFSVLTPYYTEEVLFSLRDLDSPNEDGVSILFYLQKIFPDEWNNFLQRVNCSSEEELKGNESDELEEELRLWASYRGQTLTRTVRGMMYYRKALELQSFLDMAKDEDLMEGYKAIENSEDNSNGERLWTQCQAVADMKFTYVVSCQQYGIDKRSGSPRAQDILRLMTRYPSLRVAYIDEVEETSKDRQTKINKFYYSCLVKAMPKSSSSEPEQNLDQVIYKIKLPGPAILGEGKPENQNHAIIFSRGEGLQTIDMNQDNYMEEALKMRNLLQEFLKKHDGVRYPSILGLREHIFTGSVSSLAWFMSNQETSFVTIGQRLLANPLRVRFHYGHPDVFDRLFHLTRGGVSKASRVINLSEDIFAGFNSTLREGNVTHHEYIQVGKGRDVGLNQISMFEAKIANGNGEQTLSRDVYRLGHRFDFFRMLSCYFTTIGFYFSTLITVLTVYVFLYGRLYLVLSGLEEGLSTQKAIRDNKPLQVALASQSIVQIGFLMALPMLMEIGLERGFRTALSEFILMQLQLAPVFFTFSLGTKTHYYGRTLLHGGAKYRPTGRGFVVFHAKFADNYRLYSRSHFVKGIELMILLVVYQIFGHTYRSALAYVLITISMWFMVGTWLFAPFLFNPSGFEWQKIVDDWTDWNKWISNRGGIGVPPEKSWESWWEEEQEHLQFSGIRGIIVEIVLSLRFFIYQYGLVYHLTITKKGSKSFLVYGISWLVIFVILFVMKTVSVGRRKFSANFQLVFRLIKGLIFLTFISILVTLIALPHMTVQDIVVCILAFMPTGWGMLQIAQALRPVVKRAGFWGSVKTLARGYEIVMGLLLFTPVAFLAWFPFVSEFQTRMLFNQAFSRGLQISRILGGHRKERSSRNKE

SEQ ID NO: 15289 - protein, 1953 aa, Cajanus cajan
MSSRAGPSEPPGPPQRRITRTQTAGNLGEAIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPYNILPLDPDSANQAIMRFPEIQAAVYALRNTRGLAWPKDYKKKKDEDVLDWLGVMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLRKVVTPIYDVIAKEAARSKKGRSKHSQWRNYDDLNEYFWSADCFRLGWPMRADADFFCLPVEQLNFDKSNDNKPSNRDKWVGKVNFVEIRSFWHIFRSFDRMWGFFILCLQAMIIVAWNGSGDPSVIFRGDVFKKVLSVFITAAILKFGQAILDVILSWKAQWSMSMHVKLRYILKVVCAATWVIVLSVSYAFTWENPPGFAQTIQSWFGNNSSSPSFFIMAVVVYLSPNMLAAVLFLFPLIRRFLERSNYRIVMLMMWWSQPRLYVGRGMHESTLSLFKYTMFWVLLIITKLAFSYYIEIKPLVGPTKAIMSVKISTFQWHEFFPRARKNLGVVVALWAPIILVYFMDTQIWYDIFSTLFGGIYGAFRRLGEIRTLGMLRSRFDSLPGAFNACLVPEEKSEPRKKGLKATLSRKFDQISNNKGKEAARFAQLWNQIITSFREEDLISNREMNLLLVPYWADRELDLIQWPPFLLASKIPIALDMAKDSNGKDRELRKRINSDHYMSSAIQECYASFKSIVKHLVQGDREKQVIEYIFSEVDKHIEAGDLISEFRLSALPSLYGQFVKLINYLLDNKHEDRDQIVILFQDMLEVVTRDIMMEDHIFSLVDSIHGGSGHEGMLLLEQQHQLFASEGAIRFPIEPVTEAWTEKIKRLYLLLTTKESAMDVPSNLEAKRRISFFSNSLFMDMPTAPKVRNMLSFSVLTPYYTEEVLFSLRELESPNEDGVSILFYLQKIFPDEWNNFLQRVNCSSEEELKGNESDELEEELRRWASYRGQTLTRTVRGMMYYRKALELQAFLDMAKDEDLMEGYKAIENSDDNSKGERSLWTQCQAVADMKFSYVVSCQQYGIDKRSGAARAQDILRLMTRYPSLRVAFIDEVEEPSKERPKKINKVYYSCLVKAMPKSSSPSETEPVQYLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTIGFYFSTLITVLTVYVFLYGRLYLVLSGLEEGLSTQKAIRDNKPLQVALASQSIVQIGFLMALPMLMEIGLERGFRTALSEFILMQLQLAPVFFTFSLGTKTHYYGRTLLHGGAKYRPTGRGFVVFHAKFADNYRLYSRSHFVKGIELMVLLIVYQIFGHTYRSGLAYFMITISMWFMVGTWLYAPFLFNPSGFEWQKIVDDWTDWNKWISIRGGIGVPSEKSWESWWEEEQEHLQYSGMRGIIAEILLSLRFFIYQFGLVYHLTFTKKTKSFLVYGISWLVIFLILFVMKTVSVGRRKFSAEFQLVFRLIKGLIFLTFVSILVTLIALPHMTIQDIVVCILAFMPTGWGMLQIAQALKPLVQRAGFWGSVKTLARGYEIVMGLLLFTPVAFLAWFPFVSEFQTRMLFNQAFSRGLQISRILGGQRKGRSSRNKE

SEQ ID NO: 15290 - protein, 1711 aa, Phaseolus vulgaris
MFGFQKHNLANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLRKVVTPIYDVIAKEAERSKKGRSKHSQWRNYDDLNEYFWSVDCFRLGWPMRADADFFCLPVEQLNFDKSNDNKPVNRDKWVGKVNFVEIRSFWHIFRSFDRMWGFFILCLQAMIIVAWNGTGDPSAIFDVNVFKKVLSVFITAAILKLGQAILDVILSWKAQWSMSMHVKLRYILKVVSAAAWVIVLSVSYAYTWENPPGFAQTIQSWFGSNSNSPSFFIMAVVVYLSPNMLAAMLFLFPLIRRFLERSNYRIVMLMMWWSQPRLYVGRGMHESTFSLFKYTMFWVLLIITKLAFSYYIEIKPLVEPTKAIMSVKISTFQWHEFFPRARKNLGVVVALWSPIILVYFMDTQIWYAIFSTLFGGIYGAFRRLGEIRTLGMLRSRFDSLPGAFNACLIPEERSETRKKGLKATLSRRFDQIPNNKGKEAARFAQLWNQIITSFREEDLISNREMDLLLVPYWADRELDLIQWPPFLLASKIPIALDMAKDSNGKDRELRKRINTDHYMYSAIKECYASFKSIVKYLVQRDREKQVIEYIFSEVDKHIEADDLTSEFRLSALPSLYEQFVKLIKYLLENKHEDRDQIVLLFQDMLEVVTRDMMMEDHIFSLVDSIHGGSGHEGMLLLEQEYQLFASEGAIRFPIEPVTEAWTEKIKRLYLLLTTKESAMDVPSNLEAKRRISFFSNSLYMDMPTAPKVRNMLSFSVLTPYYTEEVLFSLHNLDSPNEDGVSILFYLQKIFPDEWNNFLQRVKCSSEEELKGNESDELEEELRRWASYRGQTLTRTVRGMMYYRKALELQSFLDMAKDEDLMEGYKAIENSDDNSKGERSLWTQCQAVADMKFSYVVSCQQYGIDKRSGAACAQDILRLMTTYPSLRVAYIDEVEEPSKERPKKINKVYYSCLVKAMPKSSSPSETEPVQYLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDIFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTIGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIELMILLIVYQIFGHTYRSGVAYLMITIPMWFMVGTWLYAPFLFNPSGFEWQKIVDDWTDWNKWISIQGGIGVTPEKSWESWWEEEQEHLQYSGIRGIIAEILLSSRFFIYQYGLVYHLTFTKNTKSVLVYGISWVVIFLILFVMKTVSVGRRKFSAEFQLVFRLIKGLIFLTFVSVLVILIALPHMTIQDIVVCILAFMPTGWGMLQIAQALRPLVRRAGFWESVKTLARGYEIVMGLLLFTPVAFLAWFPFVSEFQTRMLFNQAFSRGLQISRILGGQRKGRSSRNKE

SEQ ID NO: 15291 - protein, 1941 aa, Medicago truncatula
MSSRPGPPSSSETQGPPLQRRITRTQTAGNLGEAIFDSEVVPSSLVEIAPILRVANEVEKTHPRVAYLCRFYAFEKAHRLDPTSSGRGVRQFKTALLQRLERENDPTLKGRIKKSDAREMQSFYQHYYKKYIQALQNAADKADRAQLTKAYQTANVLFEVLKAVNMTQSMEVDREILETQDKVAEKTEILVPYNILPLDPDSANQAIMRFPEIQAAVFALRNTRGLAWPKDYKKKKDEDILDWLGAMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENIKPAYGGEEEAFLRKVVTPIYNVIAKEAERSKRGRSKHSQWRNYDDLNEYFWSADCFRLGWPMRADADFFCLPVEHLHFDKLKDNKADNRDRWVGKGNFVEIRSFWHIFRSFDRMWSFFILSLQAMIIVAWNGPGDPTAIFNGDVFKKALSVFITAAILKFGQAILDVILNWKAQRSMSMHAKLRYILKVVSGAAWVIVLSVTYAYTWDNPPGFAQSIQSWFGSNSHSPSMFILAVVVYLSPNMLARSNYRIVMLMMWWSQPRLYVGRGMHESTFSLFKYTVFWVLLIITKLAFSYYIEIKPLVGPSKDIMNVHISHFQWHEFFPRARKNIGVVIALWAPIILVYFMDTQIWYAIFSTLFGGIYGAFRRLGEIRTLGMLRSRFESLPGAFNACLIPEEKCEPRKKGLKATLSRRFDQIPSNKGKEAARFAQLWNQIITSFREEDLISNREMDLLLVPYWADPELDLIQWPPFLLASKIPIALDMAKDSNGKDRELRKRIEFDNYMSCAVRECYASFKSIIRYLVQGDREKQVIEYILSEVDKHIEAGDLISEFKLSALPSLYGQFVALIKYLLDNKHEDRDQVVILFQDMLEVVTRDIMMEDHLLSLVDSIHGGSGQEGMLLLEQQHQLFASEGAIRFPIEPVTEAWTEKIKRLYLLLTTKESAMDVPSNLEAKRRISFFSNSLFMDMPTAPKVRNMLSFSVLTPYYTEEVLFSLRELESPNEDGVSILFYLQKIFPDEWNNFLQRVNCSNEEELKEYDELEEELRRWASYRGQTLTRTVRGMMYYRKALELQAFLDMAKDEDLMEGYKAIENSDDNSRGERSLWTQCQAVADMKFSYVVSCQQYGIDKRSGAARAQDILRLMARYPSLRVAYIDEVEEPSKERPKRISKVYYSCLVKAMPKSSSPSETEPEQCLDQVIYKIKLPGPAILGEGKPENQNHAIMFTRGEGLQTIDMNQDNYMEEALKMRNLLQEFLKKHDGVRYPSILGLREHIFTGSVSSLAWFMSNQETSFVTIGQRLLANPLRVRFHYGHPDVFDRIFHLTRGGVSKASKVINLSEDIFAGFNSTLREGNVTHHEYIQVGKGRDVGLNQISMFEAKIANGNGEQTLSRDVYRLGHRFDFFRMLSCYFTTIGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIELMILLIVYQIFGNGYRSGLSYLLITTPMWFMVGTWLYAPFLFNPSGFEWQKIVDDWTDWNKWISIRGGIGVPPEKSWESWWEEEQEHLKYSGMRGIIAEILLSLRFFIYQYGLVYHLNFTKSTKSVLVYGISWLVIFLILVILKTVSVGRRKFSADFQLVFRLMKGLVFVTFVSILVTMIALAHMTLQDIVVCILAFMPTGWGMLQIAQALKPLVRRGGFWESVKTLARGYEVIMGLLLFTPVAFLAWFPFVSEFQTRMLFNQAFSRGLQISRILGGQRKGRSSRNKE

SEQ ID NO: 15292 - protein, 1957 aa, Prunus mume
MSSSRGGSDQPPPQLQRRLTRTQTAGNLGETAFDSEVVPSSLVEIAPILRVANEVESHNPRVAYLCRFYAFEKAHRLDPTSSGRGVRQFKTALLQRLERENDPTLKGRVKQSDAREMQSFYQHYYKKYIQALTSAAHKADRAQLTKAYQTANVLFEVLKAVNMTQSMEVDREILEAHDKVAEKTKLLVPYNILPLDPDSTNQAIMKLSEIQATVFALRNTRGLPWPKEYKKKNDEDILDWLQSMFGFQKDNVANQREHLILLLANVHIRQFPKPEQQPKLDDRALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLKKVVTPIYDVIAKEAERSKRGKSKHSQWRNYDDLNEYFWSVDCFRLGWPMRAGADFFCLPIEQLRFDKSSGDNKPASGDRWVGKVNFVEIRSFWHIFRSFDRMWSFFILCLQVMIIVAWNGSGQPTAIFTAGVFEKVLTVFITAAILKLGQAVLDVILSWKARRSMSFHVKLRYILKVITAAAWVIILPVTYSYSWKNPPGFARTIKSWFGNDSHSPSLFILAVVVYLSPNMLAAVLFLFPFIRRFLERSNYRIVMLMMWWSQPRLYVGRGMHESTFSLFKYTMFWVLLIITKLAFSYYIEIRPLVGPTKAIMSVHITTFQWHEFFPRAKNNIGVVIALWAPIILVYFMDTQIWYAIFSTIFGGIYGAFRRLGEIRTLGMLRSRFQSLPGAFNARLIPAEKSEPKKKGLKATLSRNFVQDEDNKEKEAARFAQLWNKIISSFREEDLISDREMDLLLVPYWANRDLGHLIQWPPFLLASKIPIALDMAKDSNGKDKELKKRIDADNYMSCAVCECYASFKNIIRFLVQGNREKEVIDFIFSEVDKHIESNDLMVEFKMSALPDLYAQFVRLIEYLLSNKQDDRDQVVILFQDMLEVVTRDIMMEDHISSLVDSIHGVSGHEAMMPIDQHQQHQLFASSGAIRFPIEQVTEAWKEKIKRLFLLLTTKESAMDVPSNLEARRRISFFSNSLFMDMPPAPKVRNMLSFSVLTPYYTEEVLFSSHDLEVPNEDGVSILFYLQKIFPDEWNNFLQRVNCTSEEELKGSNGLDEDLRLWASYRGQTLTRTVRGMMYYRKALELQAFLDMAQDDALMDGYKAIELNSEDESKEERSLWAQCQAVADMKFTYVVSCQLYGIHKRSGDPRAQDILKLMTTYPSLRVAYIDEVEEPSKDRSKKINQKAYYSTLVKAALPKSIDSPEPVQNLDQVIYRIKLPGPAILGEGKPENQNHAIIFTRGEGLQTIDMNQDNYMEEALKMRNLLQEFLEKHDGVRHPTILGLREHIFTGSVSSLAWFMSNQENSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTIGFYYSTLITVLTVYVFLYGRLYLVLSGLEEGLSTQPAIRDNKPLQVALASQSFVQIGFLMALPMLMEIGLEKGFRTALSEFILMQLQLAPVFFTFSLGTKTHYYGRTLLHGGAKYRPTGRGFVVFHAKFADNYRLYSRSHFVKGIELLVLLLVYQIFGHTYRSAVAYILITVSMWFMVGTWLFAPFLFNPSGFEWQKIVDDWTDWNKWISNRGGIGVPPEKSWESWWEEEQEHLQHSGKRGIVAEILLSLRFFIYQYGLVYHLNIAKKTKSVLVYGISWLVIFLILFVMKTVSVGRRKFSAEFQLVFRLIKGLIFITFVSILVTLIVLPHMTLQDIIVCILAFMPTGWGILLIAQACKPVVHKAGLWPSVRTLARGFEIVMGLLLFTPVAFLAWFPFVSEFQTRMLFNQAFSRGLQISRILGGQRKDRSSRNKE

SEQ ID NO: 15293 - protein, 1957 aa, Prunus persica
MSSSRGGSDQPPPQLQRRLTRTQTAGNLGETAFDSEVVPSSLVEIAPILRVANEVETHNPRVAYLCRFYAFEKAHRLDPTSSGRGVRQFKTALLQRLERENDPTLKGRVKQSDAREMQSFYQHYYKKYIQALTSAAHKADRAQLTKAYQTANVLFEVLKAVNMTQSMEVDREILEAHDKVAEKTKLLVPYNILPLDPDSTNQAIMKLSEIQATVFALRNTRGLPWPKEYKKKNDEDILDWLQSMFGFQKDNVANQREHLILLLANVHIRQFPKPEQQPKLDDRALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLKKVVTPIYDVIAKEAERSKRGKSKHSQWRNYDDLNEYFWSVDCFRLGWPMRAGADFFCLPIEQLRFDKSSGDNKPASGDRWVGKVNFVEIRSFWHIFRSFDRMWSFFILCLQVMIIVAWNGSGQPTAIFTAGVFEKVLTVFITAAILKLGQAVLDVILSWKARRSMSFHVKLRYILKVITAAAWVIILPVTYSYSWKNPPGFARTIKSWFGNDSHSPSLFILAVVVYLSPNMLAAVLFLFPFIRRFLERSNYRIVMLMMWWSQPRLYVGRGMHESTFSLFKYTMFWVLLIITKLAFSYYIEIRPLVGPTKAIMSVHITTFQWHEFFPRAKNNIGVVIALWAPIILVYFMDTQIWYAIFSTIFGGIYGAFRRLGEIRTLGMLRSRFQSLPGAFNARLIPAEKSEPKKKGLKATLSRNFVQNEDNKEKEAARFAQLWNKIISSFREEDLISDREMDLLLVPYWANRDLGHLIQWPPFLLASKIPIALDMAKDSNGKDKELKKRIDADNYMSCAVCECYASFKNIIRSLVQGNREKEVIDYIFSEVDKHIESNDLMVEFKMSALPSLYAQFIRLIEYLLGNKQDDRDQVVILFQDMLEVVTRDIMMEDHISSLVDSVHGVSGHEAMMPIDQHQQYQLFASSGAIRFPIEQVTEAWKEKIKRLFLLLTTKESAMDVPSNLEARRRISFFSNSLFMDMPPAPKVRNMLSFSVLTPYYTEEVLFSSLDLEVPNEDGVSILFYLQKIFPDEWNNFLQRVNCTSEEELKGSNGLDEDLRLWASYRGQTLTRTVRGMMYYRKALELQAFLDMAQDDALMDGYKAIELNSEDESKEERSLWAQCQAVADMKFTYVVSCQLYGIHKRSGDPRAQDILKLMTTYPSLRVAYIDEVEEPSKDRSKKINQKAYYSTLVKAALPKSIDSPEPVQNLDQVIYRIKLPGPAILGEGKPENQNHAIIFTRGEGLQTIDMNQDNYMEEALKMRNLLQEFLEKHDGVRHPTILGLREHIFTGSVSSLAWFMSNQENSFVTIGQRLLANPLKVRFHYGHPDVFDRLFHLTRGGISKASKVINLSEDIFAGFNSTLREGNVTHHEYIQVGKGRDVGLNQISMFEAKIANGNGEQTLSRDIYRLGHRFDFFRMLSCYFTTIGFYYSTLITVLTVYVFLYGRLYLVLSGLEEGLSTQPAIRDNKPLQVALASQSFVQIGFLMALPMLMEIGLEKGFRTALSEFILMQLQLAPVFFTFSLGTKTHYYGRTLLHGGAKYRPTGRGFVVFHAKFADNYRLYSRSHFVKGIELLVLLLVYQIFGHTYRSAVAYILITVSMWFMVGTWLFAPFLFNPSGFEWQKIVDDWTDWNKWISNRGGIGVPPEKSWESWWEEEQEHLQHSGKRGIVAEILLSLRFFIYQYGLVYHLNIAKKTKSVLVYGISWLVIFLILFVMKTVSVGRRKFSAEFQLVFRLIKGLIFITFVSILVTLIVLPHMTLQDIIVCILAFMPTGWGILLIAQACKPVVHKAGLWPSVRTLARGFEIVMGLLLFTPVAFLAWFPFVSEFQTRMLFNQAFSRGLQISRILGGQRKDRSSRNKE

SEQ ID NO: 15294 - protein, 1601 aa, Euphorbia peplus
MAFELYGMLAGNVSPMTGENVKPAYGGEEEAFLRKVVTPIYDVIAKESERSKKGKSKHSQWRNYDDLNEYFWSVDCFRLGWPMRADADFFHMPTAQFRYDKNEENKPAFKDRWVGKVNFVEIRSFWHIFRSFDRMWSFYILCLQAMIIVAWNGSGQLGSVFSGDVFKKVLSVFITAAILKLGQAVLDVILCWKARQIMSFYVKLRYILKVVSAAAWVVVLPVTYAYTWENPPGFAQTIKSWFGNNSSSPSLFILAVVIYLAPNMLSAMLFLFPFLRRFLERSNYRIVMLMMWWSQPRLYVGRGMHESALSLFKYTMFWVLLLMTKLAFSYYIEIKPLVSPTKAVMSVHVTQFQWHEFFPQAKNNIGVVVALWAPIILVYFMDTQIWYAIFSTLFGGIYGAFRRLGEIRTLGMLRSRFQSLPGAFNARLIPEERSEPKKKGLKATLSRNFAEIISNKEDGAARFAQLWNKIISSFREEDLISDREMDLLLVPYWADQDLGLIQWPPFLLASKIPIALDMAKDSNGKDKELKKRIANDNYMSCAVRECYASFRNIIKFLVEGKRETEVIDFIFKEVENHINEGNLILEYKMSALPSLYDHFVKLITYLLSNKQEDRDQVVILFQDMLEVVTRDIMMEDQISSLVDSMHGGTGQEEMISFDQQYQLFASSGAIRFPIQPATEAWKEKIKRLYLLLTTKESAMDVPSNLEAKRRISFFSNSLFMDMPTPPKVRNMLSFSVLTPYYTEEVLFSLHDLEVPNEDGVSILFYLQKIFPDEWKNFLERVKCHNEDELRGMDELEEELRCWASYRGQTLTRTVRGMMYYRRALELQAFLDMAKHEDLMEGYKAIELNTDDQSKGERSMLAQCQAVADMKFTYVVSCQQYGIHKRSGDHRAQDILKLMTAYPSLRVAYIDEVEVTNKDKSKKNNQKVYYSALVKAASPKSIDPLEPVQNLDEVIYRIKLPGPSILGEGKPENQNHAIIFTRGEGLQTIDMNQDNYMEEALKMRNLLQEFLKKHDGVRHPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYVFLYGRLYLVLSGLEEGLINQKAIRDNKPLQVALASQSFVQIGFLMALPMLMEIGLERGFRTALSEFILMQLQLAPVFFTFSLGTKTHYYGRTMLHGGAKYRPTGRGFVVFHAKFAENYRLYSRSHFVKGIEMMILLVVYQIFGQPYRSAVAYLLITISMWFMVGTWLFAPFLFNPSGFEWQKIVDDWTDWNKWISNRGGIGVPPEKSWESWWEEEQEHLRHSGKRGIVAEICLSLRFFIYQYGLVYHLKITKETKSFLVYGISWLVIFVILFVMKTVSVGRRKFSANFQLVFRLIKGMIFLTFVSILVTLIALPHMTIQDIVVCILAFMPTGWGMLLIAQACKPVVQKAGFWGSVKTLARGYEIVMGLLLFTPVAFLAWFPFVSEFQTRMLFNQAFSRGLQISRILGGQRKDRSSRNKE

SEQ ID NO: 15295 - protein, 1974 aa, Ricinus communis
MSSSSRVGPDQGTPQPPRRIMRTQTAGNLGESIFDSEVVPSSLVEIAPILRVANEVESSNPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNMTQSIEVDREILEAQDKVAEKTQIYVPYNILPLDPDSANQAIMRYPEIQAAVYALRNTRGLPWPKDYKKKKDEDILDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECLCYIYHHMAFELYGMLAGNVSLSTGENVKPAYGGANEAFLRLVVTPIYDVIAKESERSKMGKSKHSQWRNYDDLNEYFWSVDCFRLGWPMRDDADFFHLPAEHYRYEKNGENSKPAFRDRWVGKVNFVEIRTFWHVFRSFDRMWSFFILCLQAMIIVAWNGSGEPNAVFNGDVFKKVLSVFITAAILKLGQAVLDVILSWKARQIMSFHVKLRYILKVVSAAAWVVILPVTYAYTWENPPGFAQTIKSWFGNNSSSPSLFILAVVIYLSPNMLAAVLFLFPILRRFLERSNYKIVMLMMWWSQPRLYVGRGMHESALSLFKYTMFWVLLIMTKLAFSYYIEIKPLVRPTKDVMNVHIITFQWHEFFPRARNNIGAVIALWAPIILVYFMDTQIWYAIFSTLFGGIYGAFRRLGEIRTLGMLRSRFQSIPGAFNACLIPEEKSEPKKKGLKATLARNFAVITSNKEDGAARFAQLWNKIISSFREEDLISNREMDLLLVPYWADEDLGLIQWPPFLLASKIPIALDMAKDSNGKDKELKKRIEAENYMSCAVRECYASFRNIIKFLVQGKRETEVIDFIFSEVEKHIDEGTLISEYKMSALPSLYDQFVRLIKHLLDNKQEDRDQVVILFQDMLEVVTRDIMMEDHISSLVDSMHGGSGHEEMILIDQQYQLFASSGAIKFPIDPATEAWKEKIKRLYLLLTTKESAMDVPSNLEARRRISFFSNSLFMDMPDAPKVRNMLSFSVLTPYYTEEVLFSLRDLEVPNEDGVSILFYLQKIFPDEWNNFLERVNCSSEEELKGSDELEEELRLWASYRGQTLTRTVRGMMYYRKALELQAFLDMARHEDLMEGYKAMELNTEDQSKGERSMLAQCQAVADMKFTYVVSCQKYGIHKRSGDPRAQDILKLMTTYPSLRVAYIDEVEVTSQDKSKKNNRKEYFSALVKAASPKSIDPSEPVQNLDEVIYRIKLPGPAILGEGKPENQNHAIIFTRGEGLQTIDMNQDNYMEEALKMRNLLQEFLKKHDGVRHPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLMTVLTVYVFLYGRLYLVLSGLEKGLISQKAIRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIEMMILLVVYQIFGQPYRSAVAYVLITISMWFMVGTWLFAPFLFNPSGFEWQKIVDDWTDWNKWISNRGGIGVPPEKSWESWWEEEQEHLRHSGKRGIVAEILLSLRFFIYQYGLVYHLKITKEHKSFLVYGISWLVIFVILFVMKTVSVGRRKFSANFQLVFRLIKGMIFLTFVSILVTLIALPHMTVQDIVVCILAFMPTGWGMLLIAQACKPLVHRMGFWGSVRTLARGYEIVMGLLLFTPVAFLAWFPFVSEFQTRMLFNQAFSRGLQISRILGGQRKDRSSRSKECRGIVSMMDEMGRNFDYWN

SEQ ID NO: 15296 - protein, 1951 aa, Citrullus lanatus
MSSRGGSDQPPPLQRRITRTQTTGNLGESVFDSEVVPSSLKEIAPILRVANEVESSNPRVAYLCRFYAFEKAHRLDPTSSGRGVRQFKTALLQRLERENDPTLMGRVKKSDAREMQSFYQHYYKKYIQALQSAADKADRAQLTKAYQTANVLFEVLKAVNMTQSIEVDREILEAQDKVAQKTQIFLPYNILPLDPDSANQTIMRYHEIQAAVIALRNTRGLLWPTDHKRKDGEDILDWLQAMFGFQEGNVANQREHLILLLANVHIRQFPKSDQQPKLDERAVTEVMKKLFKNYKKWCKYLDRKSSLWLPTIQQEVQQRKLLYMALYLLIWGEAANLRFMPECLCYIYHHMAFELYGMLAGNISPMTGENVKPAYGGENEAFLRKVVTPIYEVIAKEAARSKQGKSKHSQWRNYDDLNEYFWSVDCFRLGWPMRADADFFCPPYDQIRADRSGENKPLSKDRWVGKVNFVEIRSYWHLFRSFDRMWSFFILCLQAMIIVAWNGSGQPSAIFNVDVFMKVLSVFITAAILKLCQALLDVILSWKAHRSMSFYVKLRYILKVVSAAAWVVILPVTYAYSWENPSGFAQTIKGWFGGNRSNSPSLFILAIVIYLSPNMLAGVFFLFPFIRRFLERSNYRIVMLMMWWSQPRLYVGRGMHESTFSLVKYTLFWVLLIATKLAFSYYIEIKPLVGPTKAIMSVRITVFQWHEFFPRAKNNIGVVIALWAPIILVYFMDAQIWYAIFSTLFGGIYGAFRRLGEIRTLGMLRSRFESLPGAFNACLIPEEQGEPKKKGLKATLSRNFSVISSNKEKEGARFAQLWNKIISSFREEDLISNREMDLLLVPYWADTELGLMQWPPFLLASKIPIALDMAKDSNGKDRELKKRIDADSYMSSAIRECYASFKKIIKHLVQGAREKEVINYIFTEVDKHIEENSLISEFKMSALPKLYDRFVKLTKYLLDNKQEDKDAVVILFQDMLEDVTRDIMNEEHISSLLETLHGGSWHEGMTSLDQQYQLFASTGAIKFPVDQTEAWKEKIKRLYLLLTTKESAMDVPSNLEARRRISFFSNSLFMDMPAAPKVRNMLSFSVLTPYYTEEVLFSLHDLEEPNEDGVSILFYLQKIYPDEWKNFLERVKCTSEEELKGVSELEEELRLWASYRGQTLTKTVRGMMYYRKALELQAFLDTAEDQDLMEGYKAVELNSEENSKGDRSLWAHCQAISDMKFTYVVSCQQYGIQKQSGDARAQDILKLMTKYPSLRVAYIDEVEEPSKDKSKKNQKTYYSSLVKAASPKSINASEHVQLDEIIYQIKLPGPAILGEGKPENQNHAIIFTRGEGLQTIDMNQDNYMEEAMKMRNLLQEFLKKHDGIRHPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTIGFYFSTLITVLTVYVFLYGRLYLVLSGLEKGLSTQPAIRDNKPLQVALASQSFVQIGFLMALPMLMEIGLERGFRTALSEFVLMQLQLAPVFFTFSLGTKTHYYGRTLLHGGAKYRPTGRGFVVFHAKFADNYRLYSRSHFVKGLELMILLLVYQIFGHTYRSAVAYVLITVSMWFMVGTWLFAPFLFNPSGFEWQKIVDDWTDWNKWISNRGGIGVPPEKSWESWWEEEQEHLRHSGKRGLVAEILLASRFFIYQYGLVYHLSITQRTNTKSFLVYGISWLVIFLILFVMKTVSVGRRKFSADFQLVFRLIKGLIFLTFVSILVTLIALPHMTVQDIIVCILAFMPTGWGMLLIAQALKPLVQRAGFWGSVRTLARGYEIIMGLLLFTPVAFLAWFPFVSEFQTRMLFNQAFSRGLQISRILGGHRKDRSSRNKD

SEQ ID NO: 15297 - protein, 1957 aa, Malus domestica
MASSSRGGGSDQPPQQPLQRRLTRTQTAGNIGETAFDSEIVPSSLVEIAPILRVANEVETNNPRVAYLCRFYAFEKAHRLDPTSSGRGVRQFKTALLQRLERENDPTLKGRVKKSDAREMQSFYHQYYKKYIQALSNTHKADRAQLTKAYQTANVLFEVLKAVNMTQSMEVDREILEAHDKVAEKTQLLVPYNILPLDPDSANQAIMKYPEVQAAVFALRNTRGLPWPKEYKKKNEEDILDWLQSMFGFQKDNVANQREHLILLLANVHIRQFPKPDQQPKLDDRALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGAEEAFLRKVVTPIYLVIAKEAERSKRGKSKHSQWRNYDDLNEYFWSVDCFRLGWPMRAGADFFCMPIDQRHSDISNEDKKPASGDRWVGKVNFVEIRSFWHIFRSFDRMWSFFILCLQVMIIVAWNGSGQPTGLFDGEVFTKALSVFITAAVLKLGQAFLDVILSWKGRRSMSFHVKLRYILKVITAAMWVVILPITYAYSWKNPPVFAQTIKSWFGNNGHQPTLFILAVVIYLSPNMLAAVLFLFPFIRRFLERSNYKIVMFMMWWSQPRLYVGRGMHESTFSLFKYTMFWVLLIITKLAFSYYIEIKPLVGPTKAIMSVRITNFQWHEFFPRAKNNIGVVIALWAPIILVYFMDTQIWYAIFSTIFGGIYGAFRRLGEIRTLGMLRSRFQSLPGAFNARLIPAEKSEPKKKGLKATLSRTFVQVEVNKEKEAARFAQLWNKIISSFREEDLISNREMDLLLVPYWADRDLGSLTQWPPFLLASKIPIALDMAKDSNGKDKELKKRIEADNYMSCAVLECYASFRNIIKFLVQGEREKEVIDDIFFEVDKHIDAGDLMVEYNMSALPSLYGYFVKLIKHLLDNNKDERDQVVILFQDMLEVVTRDIMEDHMSSLVDSSHGMSGHEGMMPLDQPQQYQLFASFGAIRFPIPQVTEAWREKIKRLYLLLTTKESAMDVPSNLEARRRISFFSNSLFMNMPPAPKVRNMLSFSVLTPYYTEEVLFSLRDLEVPNEDGVSILFYLQKIFPDEWNNFLERVNCTSEEELKGSDELEEDLRLWASYRGQTLTRTVRGMMYYRKALELQSFLDMAQDEDLMEGYKAIELNSEDQKEGRSLWAQCQAVADLKFTYVVSCQLYGIHKRSGDARAQDILRLMTTYPSLRVAYIDEVEEPSKDSSKKINQKVYYSTLVKAALPKSIDSSEPVQNLDQVIYRIKLPGPAILGEGKPENQNHAIIFTRGEGLQTIDMNQDNYMEEALKMRNLLQEFLEKHDGVRYPTILGLREHIFTGSVSSLAWFMSNQENSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTIGFYYSTLITVLTVYVFLYGRLYLVLSGLEEGMSTERAIRDNKPLQVALASQSFVQIGFLMALPMLMEIGLEKGFRTALSEFVLMQLQLAPVFFTFSLGTKTHYYGRTLLHGGAKYRSTGRGFVVFHAKFADNYRLYSRSHFVKGIELLILLVVYQIFGHTYRSAVAYILITVSMWFMVGTWLFAPFLFNPSGFEWQKIVDDWTDWNKWISNRGGIGVPPEKSWESWWEEEQEHLQYSGKRGIVAEILLSLRFFVYQYGLVYHLNIAKENKSVLVYGISWLVIVVILFVMKTVSVGRRKFSAEFQLVFRLIKGLIFITFVSILVTLIVLPHMTLQDILVCILAFMPTGWGMLLIAQACKPVVHKAGLWPSVRTLARGFEIVMGLLLFTPVAFLAWFPFVSEFQTRMLFNQAFSRGLQISRILGGQRKDRSSRSKE

SEQ ID NO: 15298 - protein, 1955 aa, Eutrema parvulum
MSASRGGPDQGPSQPQQRRIVRTQTAGNLGESFDSEVVPSSLVEIAPILRVANEVESSNPRVAYLCRFYAFEKAHRLDPTSSGRGVRQFKTALLQRLEREHDPTLMGRVKKSDSREMQSFYQHYYKKYIQALQNAADKADRAQLTKAYQTANVLFEVLKAVNLTQSIEVDREILEAQDKVAEKTQLYVHYNILPLDPDSANQAIMRYPEIQAAVLALRNTRGLPWPEGHKKKKDEDMLDWLQEMFGFQKDNVANQREHLILLLANVHIRQFPKPDQQPKLDDQALTVVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIATEAQRSKKGKSKHSQWRNYDDLNEYFWSVDCFRLGWPMRADADFFYPPVDQPSTDKDGDNSKPAVARDRWVGKVNFVEIRSFWHVFRSFDRMWSFYILCLQAMIIMAWDGGEPSSVFGADVFKKVLSVFITAAIMKLGQASLDVILSFKAHRSMSLHVKLRYILKVLSAAAWVIILPVTYAYSWKDPPAFARTIKSWFGNAMHSPSLFIIAVVFYLAPNMLAAVLFLFPLLRRFLERSNYRIVMLMMWWSQPRLYVGRGMHESAFSLLKYTMFWVSLIATKLAFSYYIEIKPLVSPTQAIMRARVTNFQWHEFFPRAKNNIGVVIALWAPIILVYFMDSQIWYAIFSTIFGGIYGAFRRLGEIRTLGMLRSRFESLPGAFNDRLIPDGKDQQRKKGLRATLSHNFTEDKVPVNKEKEAARFAQLWNTIISSFREEDLISDREMDLLLVPYWADRDLDLIQWPPFLLASKIPIALDMAKDSNGKDRELKKRIESDSYMKCAVRECYASFKNVIKFLVQGNREKEVIEIIFAEVDKHIETGDLIQECRMSALPSLYDHFVKLIKYLLDNNVDDRDHVVILFQDMLEVVTRDIMLEDYNISSLVDSSHGGTWHGGMIPLEQQYQLFASSGAIRFPIEPVTEAWKEKIKRLYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEEIKESVELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSSLAQNLDQVIYRIKLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVVAYLLITISMWFMVGTWLFAPFLFNPSGFEWQKIVDDWTDWNKWINNIGGIGVPAEKSWESWWEEEQEHLRYSGKRGIVVEILLSLRFFIYQYGLVYHLTITEKTKNFLVYGVSWLVIFLILFVMKTVSVGRRKFSASFQLMFRLIKGLIFLTFISIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 15299 - protein, 1948 aa, Mimulus guttatus
MSSRGGPSQQNQPLPRRIPRTQTVGNLGESVFDSEVVPSSLVEIAPILRVANEVEPSNPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNQTQSVEVDREVLETHDKVAEKTEIYVPYNILPLDPDSANQAIMKYPEIQAAVHALRNTRGLPWPKDYKKKKDEDILDWLQSMFGFQKDSVANQREHLILLLANVHIRQFPKPDQQPKLDERALDEVMKKLFKNYRKWCKYLDRKSSLWLPTIQQEVQQRKLLYMGLYLLIWGEAANLRFMPECLCYIYHHMAFELYGMLAGNVSPMTGENVKPAYGGEEEAFLRKVITPIYEVVAREAARSKKGKSKHSQWRNYDDLNEYFWSVDCFRLGWPMRSDADFFCKTVDQLQSEKNGETRSTKDRWVGKVNFVEIRSYWHIFRSFDRMWSFFILCLQAMIIIAWNGSGQPSSIFDSGVFKKVLSIFITASVLKLGQAVLDVILSWQARKSMSFHVKLRYILKVVSAAAWVIILPITYAYSWKNPPGIAQIIKHWVGNNSNFPSLFIFTVVIYLSPNLLAGVLFLFPFVRRFLESSNYKIVMLLMWWSQPRLYVGRGMHESTFSLFKYTVFWALLLITKLAFSFYVEIKPLVGPTKTIMSAHVSNYQWHEFFPDAKNNIGVVITIWAPVILVYFMDAQIWYAIFSTLFGGIYGAFRRLGEIRTLGMLRSRFQSLPGAFNACLMPEEKNELVKKKGLKATFARKFEVIPASKEKEAARFAQLWNKIITSFREEDLISNREMDLLLVPYWADRDLEIIQWPPFLLASKIPIAVDMAKDSNGKDSELKNRIKSDDYMYSAVCECYASFRNIVKLLVRGSREKEVIEYIFSEVDKHIEEDNLLIEYKLSALPNLYDLFVRLVKYLLDNKQEDRDQVVILFQDMLEVVTRDIMMEDHISNLLDSIPGGLGHEGMTPLDQQYQLFASAGAIKFPTPGSEAWKEKIKRLYLLLTVKESAMDVPSNLEARRRISFFSNSLFMDMPSAPKVRNMLSFSVLTPYYTEEVLFSLPELEVPNEDGVSILFYLQKIFPDEWNNFMERVKCFNEEELRESHELEEQLRLWASYRGQTLTRTVRGMMYYRKALELQAFLDMAKDEDLMQGYKAIELNEDQIKGERSLWTQCQAVADMKFTFVVSCQLYGIQKRSGDPRAQDILRLMTTYPSLRVAYIDEVEEPSKDRTKKINDKVYYSTLVKAALPKSNSSEPGQNLDQVIYRIKLPGPAIMGEGKPENQNHAIIFTRGEGLQTIDMNQDNYMEEALKMRNLLQEFLKKHDVRHPSILGLREHIFTGSVSSLAWFMSNQETSFVTIGQRLLANPLKVRFHYGHPDVFDRIFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYVFLYGRLYLVLSGLEKGLSQIPGIRDNKPLEVALASQSFVQIGFLMALPMMMEIGLEKGFRTALSEFILMQLQLAPVFFTFSLGTKTHYYGRTLLHGGAKYRPTGRGFVVFHAKFADNYRLYSRSHFVKGLELMILLLVYQIFGQSYRGTVAYILITVSMWFMVGTWLFAPFLFNPSGFEWQKIVDDWTDWNKWISNRGGIGVPPEKSWESWWEEEQDHLRHSGKRGIVAEIILSLRFFIYQYGLVYHLNITRHTKSVLVYGISWLVIFAILFVMKTISVGRRKFSANFQLVFRLIKGLIFVTFVSILAILIALPHMTPRDILVCILAFMPTGWGLLLIAQACKPVVQKAGFWGSVRTLARGYEIVMGLLLFTPVAFLAWFPFVSEFQTRMLFNQAFSRGLQISRILGGHRKDRSSRSKE

SEQ ID NO: 15300 - protein, 1945 aa, Nicotiana benthamiana
MASRGGPEPSLQRRITRTQTMGNIGESMIDSEVVPSSLAEIAPILRVANEVEPSNPRVAYLCRFYAFEKAHRLDPTSSGRGVRQFKTSLLQRLERENDPTLIGRVKKSDAREMQSFYQHYYKKYIQALQNAAEKADRAQLTKAYQTANVLFEVLKAVNQTQAVEVDREILEAHDKVAEKTQILVPYNILPLDPDSVNQAIMRFPEIQAAVYALRNTRGLPWPKDYKKKKDEDILDWLQAMFGFQKDSVANQREHLILLLANVHIRQYPKPDQQPKLDERALNEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYEVIAREATRSRRGKAKHSQWRNYDDLNEYFWSVDCFRLGWPMRADADFFCLPVEELRAERNGENKPSRDRWVGKVNFVEIRSYLHIFRSFDRMWSFFILCLQAMIIIAWNGSGELSMVFTSDVFKKVLSVFITAAVLKLGQAALDVVLNWKARHSMSFYVKLRYILKVISAAAWVVILPVTYAYTWENPPSFAQTIKNWFGNNSNSPSLFILAVVIYLAPNMLAALLFLFPFVRRFLERSHYKIVMLMMWWSQPRLYVGRGMHESTFSLFKYTMFWVLLIATKLAFSFYVEIKPLVDPTKKIMNVHITTYQWHEFFPHASSNIGVVIALWAPVILVYFMDAQIWYAIFSTLFGGIYGAFRRLGEIRTLGMLRSRFQSLPSAFNACLIPEEKGDQPKKKGLKATFSRKFNRVPSNKEKEAARFAQLWNKIITSFREEDLISNREMDLLLVPYWADRELDLVQWPPFLLASKIPIAVDMAKDSNGKDRELKKRIEADPYMSSAVCECYASFRNVIKVLVSGHREKEVIEYIFSEVDKHIEAGDLTSELKMSALPSLYELFVKLIKYLLDNRQEDRDQVVLLFQDMLEVVTRDIMMEDHVSSLVDSIHGVSGYEGMVPLDKQYQLFASAGAIKFPTPESEAWKEKIKRLYLLLTVKESAMDVPSNLEARRRISFFSNSLFMEMPTAPKVRNMLSFSVLTPYYTEEVLFSSDDLDRQNEDGVSILFYLQKIYPDEWLNFIERVDCTSEDDLRFKWSPDLEEKLRHWASYRGQTLTRTVRGMMYYRRALELQSFLDMAQDDDLLEGYKAIELNEDQMKGERSLWVQCQAVADMKFTYVVSCQLYGIHKRSGDQRAQDILRLMTTYPSMRVAYIDEIEEPSKDRSKKVNPKVYYSTLAKAAISNSSEPGQNLDQDIYRIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDIFDRLFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYVFLYGRLYLVLSGLEEGLSKQPSIKNNKALQVALASQSFVQIGFLMALPMMMEIGLEKGFRTALSEFVLMQLQLAPVFFTFSLGTKTHYYGRTLLHGGAKYRPTGRGFVVFHAKFADNYRFYSRSHFVKGLELMILLLVYQIFGQGYRGAVAYVLITVSMWFMVGTWLFAPFLFNPSGFEWQKIVDDWTDWNKWMSNRGGIGVPPEKSWESWWEEEQEHLRHSGIRGIVAEILLSLRFFIYQYGLVYHLKITVKNQSFLVYGASWLVIFLVLFVMKTISVGRRKFSANLQLVFRIIKGLIFLTFVATLVILMTLLHMTPKDMVVCVLAFLPTGWGMLLIAQALKPVVRRAGFWGSVRTLARGYEILMGLLLFTPVAFLAWFPFVSEFQTRMLFNQAFSRGLQISRILGGQRKDRARNKD

SEQ ID NO: 15301 - protein, 1950 aa, Gossypium raimondii
MSSSRGSDQSQPMRRITRTQTAGNLGEAAFDSEVVPSSLSEIAPILRVANEVESSNPRVAYLCRFYAFEKAHRLDPTSSGRGVRQFKTALLQRLERENDPTLQGRVKKSDAREMQSFYQHYYKKYIQALTNAADKADRAQLTKAYQTANVLFEVLKAVNLTQSIEVDREILEAQDKVAEQTQILVPYNILPLDPDSANQAIMQYPEIQAAVYALRNTRGLPWPNDHKRKKDEDILDWLQEMFGFQKDNVANQREHLILLLANVHIRQFPKPDQQPKLDDHALTEVMKKLFKNYKKWCKYLDRKSSLWLPTIQQEVQQRKLLYMGLYLLIWGEAANLRFMPECLCYIYHHMAFELYGMLAGNVSPLTGENIQPAYGGEEEAFLKKVVTPIYEVIRREAERSKRGKSKHSQWRNYDDLNEYFWSVDCFRLGWPMRADADFFCLPIEQLVEKNGDNKPQATRDRWVGKVNFVEIRSFWHVFRSFDRMWSFFILCLQVMIIVAWNGNGQPSSIFTGDVFKKVLSVFITAAILKLGQAVLDVILSWKAQQSMSFHVKLRYILKVVSAAAWVIVLPVTYAYTSDNPSGIARTIQSWFGSASSSPSLFILAVVIYLSPNMLAAILFLFPFVRRFLESSHYKIVMLMMWWSQPRLYVGRGMHESTFSLFKYTMFWVLLIITKLAFSYYIEIKPLVGPTKAVMSVRITRFQWHEFFPQARNNIGVVIALWAPIILVYFMDTQIWYAIFSTLFGGIYGAFRRLGEIRTLGMLRSRFGSLPGAFNARLIPGDKSEKKKKGFWLFFSRSFGQPRSNKEKEAAKFAQLWNKIISSFREEDLISNKEMNLLLVPYWADRDLDQIQWPPFLLASKIPIALDMAKDSDSRDRELQKRIEADPYMFCAIRECYASFRSIIRFLVEGQREKRVIDDIFSKVDKRIADGSLIKTYKMSALPSLYDHIVKLIKLLLENKQDERGQVVLCFQDMLEIVTKDIMAEEEFSSLEHGGSGHDGMIDPLHQLFDTKKLDQLFASTGAIKFPTPVSEAWREKINRLYLLLTTKESAMDVPSNIDARRRISFFSNSLFMDMPAAPKVRNMLSFSVLTPYYTEEVLFSLQELEEPNEDGVSILFYLQKIFPDEWNNFLERVERNNEEELKESPELQEKLRLWASYRGQTLTRTVRGMMYYREALELQAFLDMAKHEDLMEGYKAIELNTEDSKENRSLKAQCEAVADMKFTYVVSCQQYGIQKRSGSERAQDILRLMTKYPSLRVAYIDEIEQRSEDRSKKLNGKVNYFSVLVRAVPKSIDSSEQNLDQEIYRIKLPGPAILGEGKPENQNHAIIFTRGEGLQTIDMNQDNYMEEALKMRNLLQEFLKKHDGVRYPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLVTVLTVYVFLYGRLYLVLSGLEQELSQEPAIRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIEMMILLIVYQIFGHTYRSTVAYVLITASLWFMVGTWLFAPFLFNPSGFEWQKIVDDWTDWNKWINNRGGIGVPSEKSWESWWEEEQEHLQYSGKRGIIAEILLALRFFIYQYGLVYHLHVTRKTKSFLVYGASWLVIVLILFVMKTVSVGRRKFSASYQLVFRLIKGLIFLTFLSILVILVTLAHMTIQDIIVCIFIFMPTGWGMLLIAQALRPVVKKAGFWGSVRTLARGYEIVMGLLLFTPVAFLAWFPFVSEFQTRMLFNQAFSRGLQISRILGGHRKDRTSRHKE

SEQ ID NO: 15302 - protein, 1735 aa, Lactuca sativa
MIFPEIQAAVVALRNTRGLPWPREYKKKNEEDILDWLQAMFGFQKDNVANQREHLILLLANVHIRQIPKPDQQPKLDERALNEVMKKLFKNYKKWCKYLDRKSSLWLPTIQQEVQQRKLLYMGLYLLIWGEAANLRFMPECLCYIYHHMAFELYGMLAGNVSPMTGENVKPAYGGDEEAFLTKVVSPIYDVIAQEAAWSKVGKSKHSQWRNYDDLNEYFWSVDCFRLGWPMRADSDFFCGPMKANESDKNGDGKSSGGRRAAKVNFVEIRSYWHVFRSFDRMWSFFILCLQAMIIVAWNGDGNPTKIFDSDVFKKVLSVFITASILKLGQAVLDVVLNWKARQAMPFYVKLRYVLKVVTAAAWVIVLPVTYAYTSKDPEGLAQTIKGWFGNSSGSPSLFILAVVAYLSPNMLAAVLFLFPFIRRYLESSDYRIVMLMMWWSQPRLYVGRGMHESTFSLFKYTTFWILLIITKLAFSYYLEIQPLVSPTKAIMSVHINTYAWHEFFPQARNNIGVVVALWAPIILVYFMDTQIWYAIFSTLFGGVYGAFRRLGEIRTLGMLRSRFESLPGAFNGCLIPPEKSDTVKKKGLKATLSRNYEAISSHKGKEAARFAQLWNKIITSFREEDLINDREMNLLLVPYWADRELDLIQWPPFLLASMIPIALDMAKDSNGKDRELKKRIENDNYMSCAVRECYASFRNIIKFLVRGRREQKVINDIFEEVDKHIDEGDIVREFKMSALPILYDHVVKLINYLLTNKQEDRDQVVILFQDMHEVVTRDIMEDQFPNLDGPGYDADEQYQLFAPAGAIMFPAPESEAWKEKINRLYLLLTVKESAMDVPSNLEARRRISFFSNSLFMDMPSAPKVRNMLSFSVLTPYYTEEVLFSLHDLEVQNEDGVSILFYLQKIFPDEWNNFLERMGCENEHDLKGNNELEDQLRLWASYRGQTLTKTVRGMMYYRKALELQAFLDMAKDDDLMEGYKAIELNEDQMKGERSLWAQCQAVADMKFTYVVSCQQYGIQKRSGDARAQNVLRLMTEYPSLRVAYIDEVEEPSKDTTKKINNKVYYSALVKAMPNSNASETGQNLDQVIYRIKLPGPAILGEGKPENQNHAIIFTRGEGLQTIDMNQDNYMEEALKMRNLLQEFLKKHDDVRYPTILGLREHIFTGSVSSLAWFMSNQETSFVTIGQRLLANPLKVRFHYGHPDVFDRLFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYVFLYGRLYMVLSGLEKGLASQPALRHNKPLQVALASQSFVQIGFLMALPMMMEIGLERGFRTALSEFILMQLQLAPVFFTFSLGTKTHYYGRTLLHGGAKYRATGRGFVVFHAKFAENYRLYSRSHFVKGIELMILLLVYQIFGESYRGAVAYLLITISIWFMVGTWLFAPFLFNPSGFEWQKIVDDWSDWNKWISNQGGIGVPPEKSWESWWEEEQEHLRYSGKRGVIVEILLALRFFIYQYGLVYHLSMTKHQKSVLVYGISWVVIFAILLVVKAISFGRMKFSAKFQLVFRLIKGAIFIMFVSILVILIALPHMTLQDIVVCILAFMPTGWGLLLIAQACKPVVKTAGFWGSVRTLARGYEIVMGLLLFTPVAFLAWFPFVSEFQTRMLFNQAFSRGLQISRILGGHRKDRSARNKE

SEQ ID NO: 15303 - protein, 1964 aa, Solanum lycopersicum
MASRGGPEPSLQRRITRTQTMGNIGESMIDSEVVPSSLAEIAPILRVANEVEPSNPRVAYLCRFYAFEKAHRLDPTSSGRGVRQFKTSLLQRLERENDPTLIGRVKKSDAREMQSFYQHYYKKYIQALQNAAEKADRAQLTKAYQTANVLFEVLKAVNQTQAVEVDREILEAHDKVAEKTQILVPYNILPLDPDSVNQAIMRFPEVQAAVYALRNTRGLPWPKDYKKKKDEDILDWLQAMFGFQKDSVANQREHLILLLANVHIRQYPKPDQQPKLDERALNEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYEVIAREAARSRRGKAKHSQWRNYDDLNEYFWSVDCFRLGWPMRADADFFCLPVDEEQAERNGDNKALSDRWLGKVNFVEIRSYLHIFRSFDRMWSFFILCLQAMIIIAWNGSGDLSMVFTSNVFKKVLSVFITAAVLKLGQATLDVMLNWKARRSMSFYVKLRYILKVISAAAWVIILPVTYAYTWENPPPFAQAIRNWFGSNSDSPSLFILAVVIYLSPNMLAALLFLFPFVRRFLERSHYKIVMLMMWWSQPRLYVGRGMHESTFSLFKYTMFWVLLIATKLAFSFYVEIKPLVEPTKKVMNVHITTYQWHEFFPHASSNIGVVIALWAPVILVYFMDAQIWYAIFSTIFGGIYGAFRRLGEIRTLGMLRSRFQSLPGAFNACLIPEEKSEQPKKKGLKATFSRNFARVPSNKEKEAARFAQLWNKIITSFREEDLISNREMDLLLVPYWADRELDLVQWPPFLLASKIPIAVDMAKDSNGKDRELKKRIEADPYMSSAVCECYASFRNVIKVLVSGRREKEVIEYIFSEVDKHIEAGNLISEYKMSSLPSLYDLFVKLIKYLLENRQEDRDQVVLLFQDMLEVVTRDIMMEDQLSSLVDSIHGAPGYEGMIPLDQQYQLFASAGAIKFPPPESEAWKEKIKRLYLLLTVKESAMDVPSNLEARRRISFFSNSLFMDMPTAPKVRNMLSFSVLTPYYTEEVLFSSDDLDKQNEDGVSILFYLQKIYPGLFVHLGFQDVCCMLYYEWNNFLERADCISEDDLRFKWSPELEENLRHWASYRGQTLTRTVRGMMYYRRALELQSFLDMAQDDDLMEGYKAIELNDDQMKGERSLWAQCQAVADMKFTYVVSCQLYGIHKRSGDQRAQDILRLMTTYPSMRVAYIDEIEEPSKDRSKKVNPKAYYSTLVKAALPNSHSTEPGQNLDQVIYRIKLPGPAILGEGKPENQNHAIIFTRGEGLQTIDMNQDNYMEEALKVRNLLQEFLKKHDGVRFPTILGLREHIFTGSVSSLAWFMSNQETSFVTIGQRLLANPLKVRFHYGHPDIFDRLFHLTRGGISKASKIINLSEDIFAGFNSTLREGNVTHHEYIQVGKGRDVGLNQISLFEAKIANGNGEQTLSRDLYRLGHRFDYFRMLSCYFTTIGFYFSTLITVLTVYVFLYGRLYLVLSGLEEGLSKEPAIKNNKPLQVALASQSFVQIGFLMALPMMMEIGLEKGFRTALSEFILMQLQLAPVFFTFSLGTKTHYYGRTLLHGGAKYRPTGRGFVVFHAKFADNYRFYSRSHFVKGLELMILLLVYQIFGQENRGAVAYILITVSMWFMVGTWLFAPFLFNPSGFEWQKIVDDWTDWNKWISNRGGIGVPPEKSWESWWEEEQEHLRHSGIRGIVAEILLSLRFFIYQYGLVYHLKITVKNQSFLVYGASWLVIILVLFVMKTISVGRRKFSANLQLVFRLIKGLIFLTFVATLVILMTLLKMTPEDMVICVLAFLPTGWGMLLIAQALKPVVRRAGFWGSVRTLARGYEIVMGLLLFTPVAFLAWFPFVSEFQTRMLFNQAFSRGLQISRILGGQRKDRSSRNKD

SEQ ID NO: 15304 - protein, 1488 aa, Brassica napus
MGGKVNFVEIRSFWHVFRSFDRMWSFYILCLQAMIIMAWDGGEPSSVFDAGVFKKVLSVFITAAIMKLGQATLDVILNFKAHRSMSLHVKLRYILKVISAAAWVIILPVTYAYSWKDPPAFARTIKSWFGSAMHSPSLFIIAVVFYLAPNMLAAVLFMFPMLRRFLERANFRIVMLMMWWSQPRLYVGRGMHEGAFALLKYTMFWVSLIATKLAFSYYIEIKPLVAPTQAIMRARVTNFQWHEFFPRAKNNIGVVIALWAPIILVYFMDSQIWYAIYSTIFGGIYGAFRRLGEIRTLGMLRSRFESLPGAFNDRLIPDGNQQRKKGLRATLSHNFTEDKVPVNKEKEAARFAQLWNTIISSFREEDLISDREMDLLLVPYWADRDLDLIQWPPFLLASKIPIALDMAKDSNGKDRELMKRIESDSYMKCAVRECYASFKNIINFLVQGNREKEVIEIIFSEVDKHIDTGALIQEYRMSALPSLYDHFVKLIKYLLDNNVEDRDHVVILFQDMLEVVTRDIMMEDYNISSLVDSSQGGAWHGGMVPLEQQYQLFASSGAIRFPIEPVTEAWKEKIKRLHLLLTTKESAMDVPSNLEARRRISFFSNSLFMDMPAAPKVRNMLSFSVLTPYYTEEVLFSMHDLDTPNEDGVSILFYLQKIFPDEWNNFLERVKCYSEEEIKESVDLEEELRLWASYRGQTLTRTVRGMMYYRKALELQAFLDMAMHEDLMEGYKAVELNSEDTSRGERSLWAQCQAVADMKFTYVVSCQQYGIHKRSGDQRAQDILRLMTRYPSLRVAYIDEVEETVKDTSKKGNQKVYYSVLVKVPKSTDHSSLAQNLDQVIYRIKLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMLLLLVVYQIFGSAYRGVLAYLLITISMWFMVGTWLFAPFLFNPSGFEWQKIVDDWTDWNKWINNIGGIGVPAEKSWESWWEEEQEHLRHSGKRGIVVEILLSLRFFIYQYGLVYHLTITERTKNFLVYGVSWLVIFLILFVMKTISVGRRKFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 15305 - protein, 1958 aa, Eucalyptus grandis
MCFKGFGGGKCPPPRGGADQPTQPPRGGSFGLRPLAPSEESSFDSEVVPSSLVEIAPILRVANEVESSNPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDKEILEAQFKVEEKTQIYVPYNILPLDPDSANQAIMKYPEIIAAVVALRNTRGLPWPKDYKKKDYDILDWLQAMFGFQKDNVANQREHLILLLANVHIRRFPNPNQPPKLDDQALTEVMKKLFKNYKKWCKFLDRKSSLWLPTIQQEVQQRKLLYMGLYLLIWGEAANLRFMPECLCYIYHHMAFELYGMLAGNVSPMTGENVKPAYGGEDEAFLTKVVTPIYQVIAKEAERSKRGRSKHSQWRNYDDLNEYFWSAECFRLGWPMRTNAGFFHLPAERQPFEKSEDSKPPHRDQWVGKVNFVEIRSFWHIFRSFDRMWSFFILCLQAMIIVAWNGSGDPTAVFTPDVFKKVLSIFITAAILKLGQAVLDVILSWKAQQSMSYFVKLRYILKVVSAASWVIILPVTYAYTWENPPGFAQTIKSWFGNGSKSPSLFILAVVVYLSPNMLAALLFLFPSVRRYLESSHYKIVTLMMWWSQPRLYVGRGMHESTFSLFKYTLFWVLLIITKLAFSYYIEIKPLVGPTKAIMSAHVTNFQWHEFFPQAKNNIGVVIAVWAPVILVYFMDTQIWYAIFSTLFGGIYGAFRRLGEIRTLGMLRSRFETLPHVFNACLIPDEKTERKKRGFFSRNYDAKDPNNKEKVEARFAQLWNTIIDSFREEDLISNREKNLLLVPYWADRELEDIIQWPPFLLASKIPIALDMAKDSNGNDRELRKRIDSDTYMSCAIRECYAQFRNIIMVLVQGQREKRVIEDIFSQVDKHIRENTLIRDRELRMSALPSLYNKFVELIKCLLLNNPEDRDKVVILFQDMLEVVTRDMMEEYTSPIDSIHGGSGNDGITPLDSQQHQLFASEGAIKFPIERQTEAWKEKIKRLDLLLTTKESAMDVPSNLEARRRISFFSNSLFMEMPAAPKVRNMLSFSVLTPYYTEDVLFSLKDLESQNEDGVSILFYLQKIFPDEWTNFLERMGCTNEDELKETDELEENLRLWASYRGQTLTKTVRGMMYYRKALELQAFLDMAKDEDLMEGYKAVELNTERGDRSLWAQCQAVADMKFAYVVSCQQYGIDKRSGHQSAHDILRLMTTYPSVRVAFIDEVEEPSKDGGRINSKAYYSTLVKAALPKSIDPSEPVQNLDQVIYRIKLPGNAILGEGKPENQNHAIIFTRGEGLQTIDMNQDNYMEEALKMRNLLQEFLKKDDGVRNPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTIGFYFSTLITVLTVYVFLYGRLYLVLSGLEKELSAQPGIRDNKPLQVALASQSFVQIGFLMALPMLMEIGLERGFRTALSDFVLMQLQLAPVFFTFSLGTKTHYYGRTLLHGGAKYRATGRGFVVFHAKFADNYRMYSRSHFVKGFELMVLLLVYEIFGQSYRGAVAYILITISMWFMVGTWLFAPFLFNPSGFEWQKIVDDWTDWNKWIGNRGGIGVPPEKSWESWWEEEQEHLRHSGKRGIIAEILLALRFFIYQYGLVYHLSITHTRSVLVYGISWLVIFLILFVMKTISVGRRKFSADFQLVFRLIKGLIFLTFVSILVTLIALPHMTIRDIIVCVLAFMPTGWGMLLIAQACKPLVVKAGIWGSVRTLARGFEIIMGLLLFTPVAFLAWFPFVSEFQTRMLFNQAFSRGLQISRILGGQRKDKDRSANSK

SEQ ID NO: 15306 - protein, 95 aa, Brassica rapa
MSASRGGGPDQGPSQPQQRRIMRTQTVGNLGESFDSEVVPSSLVEIAPILRVANEVVGSMRSRKLTGWIPPPVEEVFGSLRLHSYSVLKESMILH

SEQ ID NO: 15307 - protein, 1005 aa, Solanum phureja
MASRGGPEPSLQRRITRTQTMGNIGESMIDSEVVPSSLAEIAPILRVANEVEPSNPRVAYLCRFYAFEKAHRLDPTSSGRGVRQFKTSLLQRLERENDPTLIGRVKKSDAREMQSFYQHYYKKYIQALQNAAEKADRAQLTKAYQTANVLFEVLKAVNQTQAVEVDREILEAHDKVAEKTQILVPYNILPLDPDSVNQAIMRFPEVQAAVYALRNTRGLPWPKDYKKKKDEDILDWLQAMFGFQKDSVANQREHLILLLANVHIRQYPKPDQQPKLDERALNEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYEVIAREAARSRRGKAKHSQWRNYDDLNEYFWSVDCFRLGWPMRADADFFCLPVDVEQAERNGDNKALSDRWLGKVNFVEIRSYLHIFRSFDRMWSFFILCLQAMIIIAWNGSGDLSMVFTSNVFKKVLSVFITAAVLKLGQATLDVMLNWKARRSMSFYVKLRYILKVISAAAWVIILPVTYAYTWENPPPFAQAIRNWFGSNSDSPSLFILAVVIYLSPNMLAALLFLFPFVRRFLERSHYKIVMLMINLINFFYQLQPRLYVGRGMHESTFSLFKYTMFWVLLIATKLAFSFYVEIKPLVEPTKKIMNVHITIYQWHEFFPHASSNVGVVIALWAPVILVYFMDAQIWYAIFSTIFGGIYGAFRRLGEIRTLGMLRSRFQSLPGAFNACLIPEEKSEQPKKKGLKATFSRNFARVPSNKEKEAARFAQLWNKIITSFREEDLISNREMDLLLVPYWADRELDLVQWPPFLLASKIPIAVDMAKDSNGKDRELKKRIEADPYMSSAVCECYASFRNVIKVLVSGRREKEVIEYIFSEVDKHIEAGNLISEYKMSALPSLYDLFVKLIKFLVSFQSPLENRQEDRDQVVLLFQDMLEVVTRDIMMEDQLSRFFFGL

SEQ ID NO: 15308 - protein, 1047 aa, Valeriana officinalis
MLHFEILSRFWFEVNIEKNVIEDIFTEVDKHIEDGDLTREFRMSALPSLYDHFVKLIKYLLDNKPEDRDQVVILFQDMLEVVTRDIMEDHIPSLDINGGLGYEGMIPLEQQYQLFASAGAIIFPAPESEAWKEKINRLYLLLTVKESAMDVPSNLEARRRISFFSNSLFMEMPSAPKVRNMLSFSVLTPYYTEEVLFSLDDLEVENEDGVSILFYLQKIFPDEWNNFLERMDCKSEEELKDPEKLEELRLWASFRGQTLTKTVRGMMYYRKALELQAFLDMAKDEDLMEGYKAIELNENQMKEERSLWAQCQAVADMKFTYVVSCQKYGIHKRSGDHRAQDILKLMAAYPSMRVAYIDEVEEPSKDRKNMNKKVYYSALVKAAMPKSNTSEPGQNLDQVIYRIKLPGPAILGEGKPENQNHAIIFTRGEGLQTIDMNQDNYMEEALKMRNLLQEFLTKHDGVRYPSILGLREHIFTGSVSSLAWFMSNQETSFVTIGQRLLANPLRVRFHYGHPDVFDRLFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYVFLYGRLYLVLSGLEKGLSTSPAIRDNKPLQVALASQSFVQIGFLMALPMMMEIGLERGFRTALSDFILMQLQLAPVFFTFSLGTKTHYYGRTLLHGGAKYRATGRGFVVFHAKFAENYRLYSRSHFVKGMELMILLLVYQIFGQSYRGVVAYVLITVSIWFMVGTWLFAPFLFNPSGFEWQKIVDDWTDWNKWISNRGGIGVPSEKSWESWWEEEQEHLRHSGKRGIIAEILLALRFFIYQYGLVYHLKFTENHKSFLVYGISWLVIILILFVMKTISVGRKKFSANFQLMFRLIKGMIFIAFVSILVILIALPHMTVKDIIVCILAFLPTGWGILLIAQALKPAVHKAQFWGSVKTLARGYEVLMGLLLFTPVAFLAWFPFVSEFQTRMLFNQAFSRGLQISRILGGHKKDRSARNKE

SEQ ID NO: 15309 - protein, 1958 aa, Aquilegia formosa
MSSRRPGGEPPPQRRIMRTQTAGNLGETIFDSEVVPSSLVEIAPILRVANEVESSNPRVAYLCRFYAFEKAHRLDPTSSGTRWFAKFKTALLQRSGKGLCVCVRIKILSKLLTFFHYENDPTLMGRVKKSDAREMQSFYQHYYKKYIQALQNAADKADRAQLTKAYQTAAVLFEVLKAVNLTQSLEVDREVLETHNKVAEKTEVYVPYNILPLDPDTVVVALRNTRGLPWPTGYKKKPDEDILDWLQAMFGFQKDSVANQREHLILLLANVHIRQFPKPDQQPKLDERALTEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVITPIYETIAKEAERSKRGKSKHSQWRNYDDLNEYFWSVDCFRLGWPMRADSDFFCEPSSQLRLDKNGESKPAARDRWVGKINFVEIRSFWHIFRSFDRMWSFFILCLQAMIIIGWNGSGQPSAIFEADVIKKVLSIFITAAILKLGQAVLDVILSWKARRSMSFQVKLRYILKVVSAAAWVIILPVTYAYTWENPPGFALKIRKLFGNSPSSPTLYILAVVIYLAPNMLAGVLFLFPFIRRFLEKTDYRIVMFMMWWSQPRLYVGRGMHESAFSLFKYTMFWVLLIITKLAFSYYIEIKPLVGPTKTIMKAHITNYQWHEFFPRAKNNLGVVIALWAPIILVYFMDIQIWYAIFSTLFGGIYGAFRRLGEIRTLGMLRSRFQSLPGAFNARLIPVDKTAAKKKKGLKATFSRKFEEIPSNKEKEAAKFAQLWNRIISSFREEDLISDREMDLLLVPYWADRDLDLIQWPPFLLASKIPIALDMAKDSNGKDRELKKRISADNYMHCAVRECYASFRNIINFLVEGDPEKTVIKHMFDEIDKHIEADSLISQLKMSALPSLYEHFVKLIKILLENKQEDRDQVVILFQDMLEVVTRDIMEDEESTILDSIHGGLTYEGMTPLDQQVQLFASPGAIKFPIEETEAWKEKIKRLFLLLTVKESAMDVPSNLEARRRISFFSNSLFMEMPAAPKVRNMLSFSVLTPYYTEDVLFSIHELEVQNEDGVSILFYLQKIFPDEWTNFLERIGCSNEEELRKADALEEELRLWASYRGQTLSRTVRGMMYYRKALELQAFLDMAKDEDLMKGYKAAEFTTEEHSKDERSLWTQCQAVADMKFSYVVSCQQYGVHKRSGDPRAHDILKLMSTYPSLRVAYIDEVDVTVKDKSKKGNQKIYYSALVKAAPKPINSSEPQPVQNLDQVIYRIKLPGPAILGEGKPENQNHAIVFTRGEGLQTIDMNQDNYMEEAFKMRNLLDEFLKKHDGVRYPSILGLREHIFTGSVSSLAWFMSNQETSFVTIGQRLLANPLKVRFHYGHPDVFDRLFHLTRGGISKASKIINLSEDIFAGFNSTLREGNVTHHEYMQVGKGRDVGLNQISLFEAKIANGNGEQTLSRDIYRLGHRFDFFRMLSCYFTTVGFYFSTLVTVLTVYVFLYGRLYLVLSGLEEGLSTQPAIRDNKPLQVALASQSIVQLGFLMALPMMMEIGLERGFRTALSEFILMQLQLAPVFFTFSLGTKTHYYGRTLLHGGAEYRATGRGFVVFHAKFADNYRFYSRSHFVKGIEIMILLVVYQIFGHTYRSALAYVLITISMWFMVGTWLFAPFLFNPSGFEWQKIVDDWTDWNKWISNRGGIGVLPEKSWESWWEKEQEHLRHSGKRGIIAEIVLALRFFIYQYGLVYHLNLTKNTKSVLVYGASWLVIAVILLVMKTVSVGRRKFSADFQLVFRLIKGLIFLTFIGILITLVAVPHMTPQDIVVCVLAFMPSGWGLLLIAQACKPVVQRAGFWGSVRTLARGYEVIMGLLLFTPVAFLAWFPFVSEFQTRMLFNQAFSRGLQISRILGGQKKERSASNKE

SEQ ID NO: 15310 - protein, 735 aa, Arabidopsis lyrata
MKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPTVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVLSAAAWVIILPVTYAYSWKDPPAFARTIKSWFGNAMHSPSLFIIAVVFYLSPNMLAETNEKHPMCFFADATIISYIFYTLQPRLYVGRGMHESAFSLFKYTMFWVLLIATKLAFSYYIEIKPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLVNVLLVLDNKEEDRDHVVILFQDMLEVVTRDIMMEDYNISRLATFYRNVLPYEHQNLIYLVVSVAW

SEQ ID NO: 15311 - protein, 955 aa, Nicotiana benthamiana
MVPLDKQYQLFASAGAIKFPTPESEAWKEKIKRLYLLLTVKESAMDVPSNLEARRRISFFSNSLFMEMPTAPKVRNMLSFSVLTPYYTEEVLFSSDDLDRENEDGVSILFYLQKIYPGLLVDFIYLVFYEWLNFIERVDCTSEDDLRFKWSPDLEEKLRHWASYRGQTLTRTVRGMMYYRRALELQSFLDMAQDDDLLEGYKAIELNEDQMKGERSLWAQCQAVADMKFTYVVSCQLYGIHKRSGDQRAQDILRLMTTYPSMRVAYIDEIEEPSKDRSKKVNPKVYYSTLAKAAISNSSEPGQNLDQDIYRIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDIFDRLFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYVFLYGRLYLVLSGLEEGLSKQPSVKNNKALQVALASQSFVQIGFLMALPMMMEIGLEKGFRTALSEFVLMQLQLAPVFFTFSLGTKTHYYGRTLLHGGAKYRPTGRGFVVFHAKFADNYRFYSRSHFVKGLELMILLLVYQIFGQGYRGAVAYVLITVSMWFMVGTWLFAPFLFNPSGFEWQKIVDDWTDWNKWMSNRGGIGVPPEKSWESWWEEEQEHLRHSGIRGIVAEILLSLRFFIYQYGLVYHLKITVTNQSFLVYGASWLVIFLVLFVMKTISVGRRKFSANLQLVFRIIKGLIFLTFVATLVILMTLLHMTPKDMVVCVLAFLPTGWGMLLIAQALKPVVRRAGFWGSVRTLARGYEILMGLLLFTPVAFLAWFPFVSEFQTRMLFNQAFSRGLQISRILGGQRKDRSRNKD

SEQ ID NO: 15312 - protein, 760 aa, Phaseolus vulgaris
MWRLKIGDGGKNPYIFSTNNFVGRQIWEFDSEAGTDEERAQVEAARQDFYQNRFKLKACGDRLWRFQILREKKFKQKTRKVKIEDDEEITWEKATLTLKRTSHYLSALQTSDGHWPAHLGGSHFFIPIMVISIYITGHLDSVLPKEYRKEILRYLYNHQNEDGGWGLHIEGPSTMYGTTLNYISMRLLGEGANGGHNNACAKARKWIHDHGSVTHVPSWGKFWLSALGIVDWSGCNPLPPEFWILPTFLPMHPAKMWYYCRHVYMPMSYIYGKRFACPITPLIKDLREELFTQPYDESMWKKARHKCAKEDLYYPHHWIQDLICDSAYLVTEPLLTRWPFNKLIREQTLQLTMKLIHYEDENTRYIDGGCVNKALAMLACWVEDPNGDAFKKHVARVPDYLWLSEDGMCTHGLSTQSWDVGFIVQALLATNLIDDLGPTLAKAHDFIKKSQVVENRLGDFKSMFHQISKGSWTFADRDHALQLSDGTAECMKCCLLLSMLPEEIVGEKLEPERLYDSVNFLLSLQSKNGGVSVWEPAIAQKWLEHLNPAEFLADIVIEHEYLECTGSTIQALVLFKKLYPNHRREEIDNFIVKAAQFIEDEQLPNGNWHGNWGVCFTYGSWFAVGGLAAAGKSYSNCVAIRKAVKFLLSIQNEDGGWGESYLSCPMKTYVHLEGNRSNVGQTAWALLALILGGQAERDPTPLHRAAKLLINSQLEDGDWPQQEALGVYKRSCLLHYPFYRTVFPLQALSEYRNNVLVPST

SEQ ID NO: 15313 - protein, 762 aa, Phaseolus vulgaris
MWRLKIGDGGKNPYIFSTNNFVGRQIWEFDSEAGTDEERAQVEAARQHFHQNRFKLKACADRLWRFQILREKKFKQKIRKVKIEDDEEITWEKATLTLKRTSHYLSALQTSDGHWPAHVGGSHFFLPIMVISVYSTGHLDSVFLEEYRKEILRYLYNHQNEDGGWGLHIEGPSTMYGTTLNYISMRILGEGANGGHNNACAKARKWIHDHGSVTHVPSWGKFWLSVLGIVDWSGCNPLPPEFWILPTILPMHPAKMWYYCRHVYMPMSYIYGKRFVCPITPLITNLREELFSQLYDESMWKKARHKCAKEDLYYPHHWIQDLIWDSAYLVAEPLLTRWPFNKLIREKALEVTMKLIHYEDENTLYITGGCVNKALSMLACWVEDPNGDAFKKHVARIPDYLWLSEDGMCIQGINSQSWDAGFIVQALLATNLIDDLGPTLAKAHDFIKRSQVVENRTGDFKSMFHHISKGAWTFADRDHTVQISDCTAEYMKCCLLLSMLPEEIVGEKLKLERLYDSVNFILSHQSKNGGVFVWEPAIAQKWLEHLNPAEFLADIVIEHEYIECTGAIIRALVLFEKLYPNHRREEIDNFIVKAAQFIEDEQLPNGTWHGNWGVCFTYSSWLAVGGLVAAGKSYTNCVAIRKAVKFLLSIQNEDGGWGESYLSCSMKTYVPLEGNRSNVGQTAWALMVLIRAGQSERDPSPLHYAAKLLINSQLEDGDWPQQEALGAYKRSCLINYPFYRTVFPMWALTEYRNNVLMPSTFA

SEQ ID NO: 15314 - protein, 764 aa, Phaseolus vulgaris
MWRLKIGDGGKNPYIFSTNNFVGRQIWEFDSEAGTDEERAQVEAARQHFHQNRFKLKACADRLWRFQILREKKFKQKIRKVKIEDDEEITWEKATLTLKRTSHYLSALQTSDGHWPAHVGGSHFFLPIMLNLFNKDKLRNNPHVVVIFHLFLKGRRYLITGHLDSIFPEEYCKEILRYLYNHQNEDGGWGLHIEGASTMYGTTLNYVSMRILGEGANDNACAKARKWIHDHGSVTHVPSWGKFWLSVLGIVDWSGCNPLPPEFWILPTFLPMHPGKMWYYCRHVYMPMSYIYGKRFVCPITPLITNLRKELFTQPYDESTWKKARHKCAKEDLYYPHHWIQDLIWDSAYLVTEPLLTRWPFNKLIREKALEVTMKLIHYEDENTRYITGGCVNKALSMLACWVEDPNGDAFKKHIARIPDYLWLSEDGMCIQGINSQSWDAGFIVQALLATNLIDDLGPTLAKAHDFIKKSQVVENRSGDFKSMFHHISKGSWTFADRDHALQVSDDTAECMKCCLLLSMLPEEIVGENLELERLYDSVNFILSHQSKNGGVSVWEPAIAQKWLEHLNPAEFLADIVIEHEYLESNGATIQALALFKKIYPKHRREEIENFIVKAAQFIEDEQLPNGTWHGNWGICFTYSSWFAVGGLVAAGKSYNNCVAIRKAVKFLLSIQNEDGNRSNIGQTAWALLALILASQAERDPTPLHRAAKLLINSQLEDGDWPQQETLGAYKRNCLLHYPLYRIVFPMWALTEYRNNVLVSSTSV

SEQ ID NO: 15315 - protein, 700 aa, Phaseolus vulgaris
MWRLKIGDGGKNPYIFSTNNFVGRQTWEFDSEAGTDEERAQVEAARQDFYQNRFKLKACGDRLWRFQVFSIYVTGHLDFVFPKEYCKEILRYLYNHQNEDGGWGLHIEGPSTMYGTTLNYISMRILGEGANGGHNNACAKARKWIHDHGSVTHVPSWGKFWLSVLGIVDWSGCNPLPPEFWILPTFLPMHPAKMWYYCRSVYLPMSYIYGKRFVCPTTPLITDLREELFTQPYDESTWKKARHKCAKEDLYYPHHWIQDLIWDSAYLFTEPLLTRWPFNKLVREKALEVTMKLIHYEDENSRYTDGGCVNKALSMLACWVEDPNGDAFKKHVVRIPDFLWLSEDGMCVQGLYSQSWDAGFIVQALLATNLIDDLGPTLAKAHDFIKKSQVVENRSGDFKSMFHNISKGSWTLADRDHGLQISDGTAGCMKCCLLLSMLPQEIVGEKLEPERLYDSINFILSLQSKNGGVSVWEPAKAQKWLEHLNPAEFLADIVIEHEYIECTGATIQALALFKKLYPKHRRQEIENFIVKAAQFIEDEQLPNGTWHGNWGICFTYSSWLAVGGLVAVGKSYSNCVAIRKAMKFLLSIQNEDGGWGESYLSCSMKTYVPLEGNRSNIGQTAWALITLIRAGQAERDPTPIHRAAKLLINSQLEDGDWPQQEALGAFKGSCLLHYPFYRTVFSMWALTEYRNNVLVSSTSV

SEQ ID NO: 15316 - protein, 1010 aa, Setaria italica
MELPLASAKPSPRAAGAACPPLLFSPLKPFPLLRFPPRRPAAARLRLRPRAAAAGEASSPGEEVFGGRKELTGVQPLVEALPPAARTAAELAVAAAAIAAGYGIGLRAGGGSRAVAVAGAAVLGAASVAGAAAVNSVVPEVAAVGLHNYVAGHDDPTNLDNGEVEAIAKKYGVSTQDAAFKAELCDLYARYIYSVLPPGDEDLKGSEVQAITKFKRALGLDDVDAANMHMEIGRHIYRERLETSDRDADMEQRRAFQKLIYVSNLVFGDQSAFLLPWKRLFGVTESQIDIAMRENAKNLYSSQLKSIGRGLDIGTLIDVRRAQLAYKLSDEIAAEMFREHAKKLVEENISSALDIMKSRIPDSLTKAVEEVKSVIRFNSLLTILSKHPQADRFARGLGPISLGGEYDHDRRADDLKILYKAYATEVLSDGIVDDEKLAPLNELRNVFGLGKREAEGILSDVKAHIYRRTLAKAFNTELASVPSKAAFLQILCEKLQFDPELASKMHEEIYRQKLQQFVADGELSKEEVEALMAFQVRLCIPQETVDAAHTEICGQLFEKVVKEAIASVDGYDADRREAVRKAAQSLNLKKEAAMVIFSKAVRKLFLSYIQRAKEADNPIETAKELKKLISFNTVVVSELLADIKGELSSTAETEASSAASESEGEDDEYEWESLDTLRKTRPDKELKEKLRKSIQKEITLKDDIPLRDRTELYETYLKFCISGETTNVSFGTAISTKKDNSEFLMLKQLGDILGLTRKEAQDVHIKFTEKAFVQQAEVILADGKLTEAKAEQLAKIQKQFGLPTENAQKIIKGITTTKLSSAIEASVARGQIGIQQVRGLKDANFQLDSLIAEPLRESIYRKTVEEIFSSGTGDFDEEEVYVKIPADLIISAEKAKSIVQDIAKVRLENSLVQAIALLRQKKRDDVLSSLNDLLACDAAVPAPQPLSWPTPGELDDLYAIYLKGTPKPEKLSRLQYLLGISNETANKIRDTASEGTLPIAAADEKEELAF

SEQ ID NO: 15317 - protein, 922 aa, Panicum virgatum
PAARTAAELAVAAAAIAAGYGIGLRAGGGSRAVAVAGAAVLGAASLAGAAAVNSVVPEVAAVGLHNYVAGHDDPTNMESGEVEAIAKKYGVSTQDAAFKAELCDLYARYVYSVLPPGDEDLKGSEVQAIIKFKRALGLDDVDAANMHMEIGRRIYRERLETSDRDADMEQRRAFQKLIYVSNLVFGDQSAFLLPWKRLFGVTDSQIDIAMRENAKSLYSSQLKSIGRGLDIGTLIDVRRAQLAYKLSDEIATEMFREHAKKLVEENISSALDILNLTQAVEEVNIVIKFNSLLTTLSKHPQADRFARGLGPISLGGEYDHDRRADDLKILYKAYATEVLSDGIVDDEKLAPLNELRNIFGLGKREAEGILSDVKSNIYRRTLAKAFNTELASVPSKAAFLQILCEKLQFDPELASKMHEEIYRQKLQQFVADGELSKEEVEALMAFQMRLCIPQETVDAAHAEICGQLFEKVVKEAIASVDGYDADRREAVKKAAQSLNLKKEAVMAIFSKAVRKLFLSYIQRAKEAGNRIETAKELKKLISFNTVVVSELLADIKGELSPTAETEASSVTSESEGEDDEYEWESLETLRKTRPDKELKEKLRKSVQKEITLKDDIPLRDRTELYETYLMFCITGETTNVSFGTAISTKKDDSEFLMLKQLGDILGLTRKEAQDVHIKFTEKAFVQQAEVILADGKLTEAKADQLAKIQKQFGLPTENAQKIIKGITTTKLSSAIEASVARGQIGIQQVRGLKEANFQLDSLISESLRESIYRKTVEEIFSSGTGDFDEEEVYVKVPADLIISAEKAKSIVQDIAKVRLENSLVQAIALLRQKKRDNVLSSLNDLLACDTAVPASQPLSWPTPGELDDLYAIYLKSIPKPEKLSRLQYLLGISNEKANKIRDAASEGTLPIAAAEEKEELTF

SEQ ID NO: 15318 - protein, 1019 aa, Oryza sativa
MELALASAKPSPSPAPAPLLFAPLKPLPLLRFPPRRPRASSSSVGARLRAGRRGLRLLCRAAVGAGEEVFGPRRELAGVQPLVEALPPAARTAAELAVAAAAVAAGYGIGLRAGGGSRAVAVAGAAVLGAASVAGAAAVNSVVPEVAAVGLHNYVAGCDDPTKLESGEVEALATKYGVSTQDAAFKAELCDLYARFLYSVLPPGDEDLKGDEVQTIIKFKNALGLDDVDAANMHMEIGRRIYRERLETRDRDADMEQRRAFQKLIYVSNLVFGDASTFLLPWKRLFGVTDSQIDIAMRENAKILYASQLKSIGRGLDIGTLIEVRRAQLAYKLSDEIAAEMFKEHAKKLVQENISSALDIVKSRTKAANSPTQVIEDVKSILAFNSLLITLSKHPDQDRFIRGLGPISLGGESDHDRRADDLKLLYRAYATEVLSDGHLDDEKLAPLNQLRNIFGLGKREAESIMSDVKAQVYRKRLAKSFNSELAAAPSKAAFLQNICEELQFDPELASKMHEDIYRQKLQQFVADGELNKDEVEALMAFQVRLCIPQETVDAVHSEICGKLFEKVVVEAISSVDGYDTNRRQAVKKAAQGLNLKNESVMAIFSKVVRKLFLNYIQRAKAAGNRIETAKELKKMISFNTVVVSELLADIKGEPTTAEPQTSDATSEPEVSESEGDDEYEWEQLETLRKTRPDKELREKLAKSSQKEITLKDDIPLRDRAELYETYLVFCVTGETTNVSFGTAISTKKDNSEYLMLKQLGDILGLTRKEAQNVHIKMAEKAFVQQAEVILADGKLTEAKADQLAKIQKQVGLPTEYAQKIIKNITTTKLSSAIEASISRGQIGIQQVRGLKEANFQLDSLIAEPLRENIYKKSVEEIFSSGTGEFDEEEVYVKIPADLIINAEKAKSIVQDIAKIRLDNALVQAVALLRQKKKDEVVASLNDLLACDAAVPASKPLSWPTSGELDDLYGIYMKSIPKPEKLSRLQYLLGISDEKAGQIRDAASAGTLSVATEEEDELVF

SEQ ID NO: 15319 - protein, 1019 aa, Oryza sativa
MELALASAKPSPSPAPAPLLFAPLKPLPLLRFPPRRPRASSSSVGARLRAGRRGLRLLCRAAVGAGEEVFGPRRELAGVQPLVEALPPAARTAAELAVAAAAVAAGYGIGLRAGGGSRAVAVAGAAVLGAASVAGAAAVNSVVPEVAAVGLHNYVAGCDDPTKLESGEVEALATKYGVSTQDAAFKAELCDLYARFLYSVLPPGDEDLKGDEVQTIIKFKNALGLDDVDAANMHMEIGRRIYRERLETRDRDADMEQRRAFQKLIYVSNLVFGDASTFLLPWKRLFGVTDSQIDIAMRENAKILYASQLKSIGRGLDIGTLIEVRRAQLAYKLSDEIAAEMFKEHAKKLVQENISSALDIVKSRTKAANSPTQVIEDVKSILAFNSLLITLSKHPDQDRFIRGLGPISLGGESDHDRRADDLKLLYRAYATEVLSDGHLDDEKLAPLNQLRNIFGLGKREAESIMSDVKAQVYRKRLAKSFNSELAAAPSKAAFLQNICEELQFDPELASKMHEDIYRQKLQQFVADGELNKDEVEALMAFQVRLCIPQETVDAVHSEICGKLFEKVVVEAISSVDGYDTNRRQAVKKAAQGLNLKNESVMAIFSKVVRKLFLNYIQRAKAAGNRIETAKELKKMISFNTVVVSELLADIKGEPTTAEAQTSDATSEPEVSESEGDDEYEWEQLETLRKTRPDKELREKLAKSSQKEITLKDDIPLRDRAELYETYLVFCVTGETTNVSFGTAISTKKDNSEYLMLKQLGDILGLTRKEAQNVHIKMAEKAFVQQAEVILADGKLTEAKADQLAKIQKQVGLPTEYAQKIIKNITTTKLSSAIEASISRGQIGIQQVRGLKEANFQLDSLIAEPLRENIYKKSVEEIFSSGTGEFDEEEVYVKIPADLIINAEKAKSIVQDIAKIRLDNALVQAVALLRQKKKDEVVASLNDLLACDAAVPASKPLSWPTSGELDDLYGIYMKSIPKPEKLSRLQYLLGISDEKAGQIRDAASAGTLSVATEEEDELVF

SEQ ID NO: 15320 - protein, 1032 aa, Brachypodium distachyon
MELSLVSAKPSPSPRAAASALLFAPLKPFPLLRFPPRRAAPFARLRSQRFQFRRAAGSGDGEGESDATARGEVFGGRREEVFGGRKELTGVQPLVESLPPAARTAAELAVAAAAVAAGYGIGLRLGGGSRAAAVAGAAVLGAASVAGAAAVNSVVPEVAAVGLHNYVVGCDDPTKLETSEVEAIASKYGVSTQDAAFKAELCDLYASFLYSVLPPGDEDLKGNEVEVITKFKSALGLDDVDAANMHMEIGRRLYRERLETRDRDADMEQRRAFQKLIYVSNLVFGDASAFLLPWKRLFGITDSQIDIAMRDNAKNLYTSQLKSIGRDLDIGTLIEVRRAQLAYKLSDEIAADMFREHAKKLIQENISSALDILKSRTKAANSPTQVIEEVKIVLAFNSLLTVLSKHPQGDRFVRGLGPISLAGELDHDRRAGDLKILYRAYATEVLSDGPLDNEKLIPLNELRNIFGLGKREAEAIISDVKSQVYRKRLAKCFNTELAAAPSKASFLQNLCEELEFDPELASKMHEDIYRQKLQQFVADGELSKDETEALMAFQVRLCIPQETVDAAHTDICGQLFEKVVKEAIVSVDGYNADRRDAVRKAAQGLNLKKEAAMTIFSKAVRKLFLNYIQRAKAAGNRIEQAKELKKLISFNTVVVSELLADIKGEPTATAEPATSSTTSEPETTESEGEDDYEWESLETLKKTRPDKELKEKLDKSSQKEITLKDDLPLRDRAELYQTYLMFCITGETTNVSFGTAISTKKDNSEYLMLKQLGNILGLTRKEAQDVHIKLAEKAFVQQAEVVLADGKLTESKADQLAKIQKQVGLPDEHAQKIIKSITTTKLSSAIEASIARGQIGIQQVRGLKEANFQLDSLIAEPLRETIYKKSAEEIFSSGTGEFDEEEVYVKMPADLIINAEKAKSIVQDIAKVRLENALVQAVALLRQKKKDGVISSLNDLLACDAAVPASKPLSWPSPGELDDLYCLYLKSIPKPEKLSRLQYLLDISAEKAGQLRDAASAGTLPVASQEEEELAF

SEQ ID NO: 15321 - protein, 547 aa, Saccharum officinarum
AGHDDPTNLDYGEVEAIAKKYGISTQDEAFKAELCDLYARYVYSVLPPGDEDLKGTEVQAIIKFKRALGLDDVDAANMHMEIGRHIYRERLETSDRDADMEQRRAFQKLIYVSNLVFGDASAFLLPWKRLFGVTESQMDIAMRENAKSLYSVQLKSIGRGLDIGTLIDLRGAQLAYKLSDEIAAEMFREHVKKLVQENISSALDILKSRIPDSLTQAVEEVNIVIKFNSLLTTLSKHPQADRFARGLGPISLAGEHDHDRRADDLKILYKAYATEVLSDGIVDDEKLSPLNELRNIFGLGKRETERILSDVKAHIYRKTLAKSFNTELASVPSKAAFLQILCEKLQFDPELASKMHEEIYRQKLQQFVADGELSKEEVEALMAFQVRLCIPQETVDAAHTEICGQLFEKVIKEAIASVDGYNADRREAVRKAAQSLNLKPEAAMAIFSKAVRKLFLSYIQRAKEAGNRIETAKELKKLISFNIVVVSELLADIKGEISPVAETEASSAASESEGEDDEHEWESLDTLRKTRPDKELKEKLRKSSRKR

SEQ ID NO: 15322 - protein, 289 aa, Brachypodium distachyon
MELSLVSAKPSPSPRAAASALLFAPLKPFPLLRFPPRRAAPFARLRSQRFQFRRAAGSGDGEGESDATARGEVFGGRREEVFGGRKELTGVQPLVESLPPAARTVAELAVAAAAVAAGYGIGLRLGGGSRAAAVAGAAVLGAASVAGAAAVNSVVPEVAAVGLHNYVVGCDDPTKLETSEVEAIASKYGVSTQDAAFKAELCDLYASFLYSVLPPGDEDLKGNEVEVITKFKSALGLDDVDAANMHMEIGRRLYRERLIGVSKANLCVKSCLRRCISLPTSMEEAFRDH

SEQ ID NO: 15323 - protein, 478 aa, Saccharum officinarum
MAELKRLSESRDLTRIERIGAHSHIRGLGLDSSMEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPLSASGAGGSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDEIRKILDIRCDEEDVEMSADAKVLLTKIGVETSLRYAINLITSAALACQRRKGKVVEMEDISRVYQLFLDVKRSTQYLMEYQSQYMFNEVPGEGDGEDAMQT

SEQ ID NO: 15324 - protein, 480 aa, Sorghum bicolor
MAELKRLSESRDLTRIERIGAHSHIRGLGLDSSMEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPLSASGAGGSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEEEIRKILDIRCDEEDVEMSADAKVLLTKIGVETSLRYAINLITSAALACQRRKGKVVEMEDISRVYQLFLDVKRSTQYLMEYQSQYMFNEVPGEADGDGEDAMQS

SEQ ID NO: 15325 - protein, 478 aa, Zea mays
MAELKRLSESRDLTRIERIGAHSHIRGLGLDSSMEARDASEGMVGQLPARRAAGLILQLIRQGKIAGRAVLLAGQPGTGKTALAMGIAKSLGAETPFASVAASELFSLDLSKTEALTQAFRRAIGVRIKEETEIIEGEVVEILIDRPLSASAAGGSSAAPTGATAAGKSGRLTLKTTDMETVYELGGKMIEALGKEKVQSGDVIALDKASGKVTKLGRSIGRSRDYDAVGPHTKFVKCPDGELQKRKEIVHCVTLHEIDVINSRTQGFLALFTGDTGEIRAEVREQIDTKVAEWREEGKADIVPGVLFIDEVHMLDIECFSFLNRALENDMAPILVIATNRGITSIRGTNYRSPHGIPPDFLDRLLIITTQPYTEDEIRKILDIRCDEEDVEMSADAKVLLTKIGVETSLRYAINLITSAALACQRRKGKVVDMEDISRVYQLFLDVKRSTQYLMEYQSQYMFNEVPGEADGEDAMQS

SEQ ID NO: 15326 - protein, 478 aa, Setaria italica
MAELKRLSESRDLTRIERIGAHSHIRGLGLDSSMEARDASEGMVGQLPARRAAGLILQLIRQGKIAGRAVLIAGQPGTGKTALAMGIAKSLGAETPFASVAASELFSLDLSKTEALTQAFRRSIGVRIKEEAEIIEGEVVEISIDRPLSASSAGGSSSAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDEIRKILDIRCDEEDVEMSADAKVLLTKIGVETSLRYAIHLINSAALACQKRKGKVVEMEDISRVYQLFLDVKRSTQYLMEYQSQYMFNEVSGEADGNDAMQS

SEQ ID NO: 15327 - protein, 253 aa, Setaria italica
MMLLAHTPSLSSALMVSSRSARRSCIVSPYMRSMSSIAGRQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDEIRKILDIRCDEEDVEMSADAKVLLTKIGVETSLRYAIHLINSAALACQKRKGKVVEMEDISRVYQLFLDVKRSTQYLMEYQSQYMFNEVSGEADGNDAMQS

SEQ ID NO: 15328 - protein, 475 aa, Setaria italica
MAELKRLAESRDLTRIERIGAHSHIRGLGLDSSLEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPLSAAAGSAAPSGATAPGKTGRLTLKTTDMETVYELGGKMIEALGKEKVQSGDVVALDKASGKVTKLGRSIGRSRDYDAVGPHTKFVKCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDDIRKILDIRCDEEDVEMSADAKVLLTKIGVETSLRYAIHLITSAALACQKRKGKVVEMEDISRVYQLFLDVKRSTQYLMEYQSQYMFNEVPGEADGDDAMQS

SEQ ID NO: 15329 - protein, 478 aa, Panicum virgatum
MAELKRLSESRDLTRIERIGAHSHIRGLGLDSSMEARDASEGMVGQLPARRAAGLILQLIRQGKIAGRAVLIAGQPGTGKTALAMGIAKSLGAETPFASVAASELFSLDLSKTEALTQAFRRAIGVRIKEEAEIIEGEVVEISIDRPLASSGAGSSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYKEDEIRKILDIRCDEEDVEMSADAKVLLTKIGIETSLRYAIHLINAAALACQKRKGKVVEMEDISRVYQLFLDVKRSTQYLMEYQSQYMFSEVSGEADGDDAMHS

SEQ ID NO: 15330 - protein, 478 aa, Panicum virgatum
MAELKRLSESRDLTRIERIGAHSHIRGLGLDSSMEARDASEGMVGQLPARRAAGLILQLIRQGKIAGRAVLIAGQPGTGKTALAMGIAKSLGAETPFASVAASELFSLDLSKTEALTQAFRRAIGVRIKEEAEIIEGEVVEISIDRPLASSGAGSSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYKEDEIRKILDIRCDEEDVEMSADAKVLLTKIGIETSLRYAIHLINAAALACQKRKGKVVEMEDISRVYQLFLDVKRSTQYLMEYQSQYMFSEVSGESDGDDAMHS

SEQ ID NO: 15331 - protein, 476 aa, Oryza sativa
MAELKRLSESRDLTRIERIGAHSHIRGLGLDSSLEARGSSEGMVGQLPARRAAGLILQLIRQGKIAGRAVLLAGQPGTGKTALAMGIAKSLGAETPFASVAASELFSLDLSKTEALTQAFRRSIGVRIKEEAEIIEGEVVEISIDRPVSAAAAAGSSAPSGVAAAGKTGRLTLKTTDMETVYELGGKMIEALGKEKVQSGDVVALDKASGKVTKLGRSIGRSRDYDAVGPHTKFVKCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDDIRKILDIRCDEEDVEMSADAKVLLTKIGVETSLRYAIHLITSAALACQKRKGKVVEMEDISRVYQLFLDVKRSTQYLMEYQSQYMFNEVPGEAGDDAMQS

SEQ ID NO: 15332 - protein, 476 aa, Oryza sativa
MAELKRLSESRDLTRIERIGAHSHIRGLGLDSSLEARGSSEGMVGQLPARRAAGLILQLIRQGKIAGRAVLLAGQPGTGKTALAMGIAKSLGAETPFASVAASELFSLDLSKTEALTQAFRRSIGVRIKEEAEIIEGEVVEISIDRPVSAAAAGSSSAPSGVAAAGKTGRLTLKTTDMETVYELGGKMIEALGKEKVQSGDVVALDKASGKVTKLGRSIGRSRDYDAVGPHTKFVKCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYTEDDIRKILDIRCDEEDVEMSADAKVLLTKIGVETSLRYAIHLITSAALACQKRKGKVVEMEDISRVYQLFLDVKRSTQYLMEYQSQYMFNEVPGEAGDDAMQS

SEQ ID NO: 15333 - protein, 476 aa, Brachypodium distachyon
MSELKRLSESRDLTRIERIGAHSHIRGLGLDSSLEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPLSAASGSSGAPSGAAAAGKTGRLTLKTTDMETVYELGGKMIEALGKEKVQSGDVIALDKASGKVTKLGRSIGRSRDYDAVGAHTKFVKCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPSDFLDRLLIITTQPYTEDEIRKILDIRCEEEDVDMSADAKVLLTKIGTETSLRYAIHLITSAALACQKRKGKVVEMEDISRVYQLFLDVKRSTQYLMEYQSQYMFSEVQGEADGDDAMQS

SEQ ID NO: 15334 - protein, 263 aa, Oryza sativa
MAELKRLSESRDLTRIERIGAHSHIRGLGLDSSLEARGSSEGMVGQLPARRAAGLILQLIRQGKIAGRAVLLAGQPGTGKTALAMGIAKSLGAETPFASVAASELFSLDLSKTEALTQAFRRSIGVRIKEEAEIIEGEVVEISIDRPVSAAAAAGSSAPSGVAAAGKTGRLTLKTTDMETVYELGGKMIEALGKEKVQSGDVVALDKASGKVTKLGRSIGRSRDYDAVGPHTKFVKCPEGELQKRKEVVHCVTLHEIDVINSR

SEQ ID NO: 15335 - protein, 171 aa, Secale cereale
MAELKRLSESRDLTRIERIGAHSHIRGLGLDSSIEARDASEGMVGQLPARRAAGLILQLIRQGKIAGRAVLLAGQPGTGKTALAMGIAKSLGAETPFASVAASELFSLDLSKTRGRSHRRSAAPLAFASRRKRRSLRARSLRSQSTALSPPVAARAYLQVLPRPGRREGSR

SEQ ID NO: 15336 - protein, 475 aa, Secale cereale
MAELKRLSESRDLTRIERIGAHSHIRGLGLDSSIEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPVSASGSSGIPSGATAAGKTGRLTLKTTDMETVYELGGKMIEALGKEKVQSGDVIALDKASGKVTKLGRSIGRSRDYDAVGAHTKFVKCPEGELQKRKEVMHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPSDFLDRLLIITTQPYTAGEIRKILDIRCEEEDVEMSTEGKDLLTKIGTETSLRYAIQLITSAGLACQKRKGKVVEMEDISRVYHLFLDVKRSTQFLIDSQSDYMFSEVQGDSDGDDAMQS

SEQ ID NO: 15337 - protein, 474 aa, Triticum aestivum
MAELKRLSESRDLTRIERIGAHSHIRGLGLDSSIEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPVSASSSGIPSGATAAGKTGRLTLKTTDMETVYELGGKMIEALGKEKVQSGDVIALDKASGKVTKLGRSIGRSRDYDAVGAHTKFVKCPEGELQKRKEVMHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPSDFLDRLLIITTQPYTAEEIRKILDIRCEEEDVEMSAEGKDLLTKIGTETSLRYAIQLITSAGLACQKRKGKVVEMEDISRVYHLFLDVKRSTQFLIDSQSDYMFSEVQGDSDGDDAMQS

SEQ ID NO: 15338 - protein, 475 aa, Hordeum vulgare
MAELKRLSESRDLTRIERIGAHSHIRGLGLDSSIEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPVSASSSSGIPSGAAAAGKTGRLTLKTTDMETVYELGGKMIEALGKEKVQSGDVIALDKASGKVTKLGRSIGRSRDYDAVGSHTKFVKCPEGELQKRKEVMHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPTDFLDRLLIITTQPYSAEEIRKILDIRCEEEDVEMSAEGKDLLTKIGTETSLRYAIQLITSAGLACQKRKGKVVEMEDISRVYHLFLDVKRSTQFLIDSQSDYMFSEVQGDSDGDDAMQP

SEQ ID NO: 15339 - protein, 477 aa, Elaeis guineensis
MAELKKLSESRDLTRIERIGAHSHIRGLGLDSSLEARAVSEGMVGQQSARKAAGLILQLIREGKIAGRAILLAGQPGTGKTAVAMGLAKSLGQETPFATVSGSELFSLEMSKTEALTQAFRRAIGVRIKEEAEIIEGEVVEITIDRPAATAGGSASGSSGQSSSAFKTGKLTLKTTDMETVYDLGNKMIEALTKEKVQSGDVIALDKVSGKVTKLGRSIGRSRDYDAVGPNTKFVRCPEGELQKRKEVVHCVTLHEIDVINSRTQGFLALFTGDTGEIRSEVREQIDTKVAEWREEGKAEIVPGVLFIDEVHMLDIECFSFLNRALENDMAPILVIATNRGITTIRGTNYRSPHGIPPDFLDRLLIISTQPYTEEEIRKILDIRCEEEDVEMSKDAKVLLTKIGAETSLRYAINLITAAALACQKRRGKIVEMEDISRAYQLFLDVKRSTQYLMEYQSQYMFNEVPREVDEDETMQS

SEQ ID NO: 15340 - protein, 484 aa, Amorphophallus konjac
MAELKRLSESRDLTRIERIGAHSHIRGLGLDSGLEARATSQGMVGQVSARRAAGVILEMIREGKIAGRAVLLAGQPGTGKTAIAMGMAKSLGEETPFAVISGSELFSLEMSKTEALTQAFRRAIGVRIKEETEIIEGEVVEIVIDRPAAAAVANSSGGGSAHPPSSSSSVSATKTGKLTLKTTDMETVYELGGKLIEALSKEKVQSGDVIALDKSSGKVTKLGRSIGRSRDYDAVGPHTRFVRCPEGELQKRKEVVHCVTLHEIDVINSRTQGFLALFTGDTGEIRAEVREQIDTKVAEWREEGKAEIVPGVLFIDEVHMLDIECFSFLNRALENEMAPILVIATNRGITTIRGTNYKSPHGIPIDFLDRLLIITTQPYTEEEIRQILDIRCQEEEVEMSEDAKVLLTKIGVETSLRYAINLITASALSCQKRKGKTVEMEDISRVYQLFIDVKRSTQYLMEYQSQYMFNEVPRDAEEDEIMQS

SEQ ID NO: 15341 - protein, 165 aa, Phalaenopsis aphrodite
LSESRDLTRIERIGAHSHIRGLGLDSSLEARAVSEGMVGQQPARKAAGLILQLIKEGKIAGRAVLLAGQPGTGKTAIAMGLAKSLGEETPFATLSGSELFSLEMSKTEALTQAFRRAIGVRIKERPRSSRVRLLRSPLTVLLASADLVRVLHPRDLPVLRQGSSR

SEQ ID NO: 15342 - protein, 464 aa, Aristolochia fimbriata
MAELKISETRDLTRIERIGAHSHIRGLGLDSALEPRDVSEGMVGQASARKGAGVILHMIREGKIAGRAVLLAGQPGTGKTAIAMGLAKSLGQETPFAMLAGSELFSLEMSKTEALTQAFRKAIGVRIKEETEVIEGEVVELQIDRPAVAGAASKTGKLTLKTTEMETVYDLGTKMIESLGKEKVQSGDVIAIDKSSGKITKLGRSFARSRDYDAMGPQTKFVQCPDGELQKRKEVVHCVTLHEIDVINSRTQGFLALFTGDTGEIRAEVREQIDTKVAEWREEGKAEIIPGVLFIDEVHMLDIECFSFLNRALENDMAPILVVATNRGITTIRGTNYKSPHGIPIDLLDRLLIISTQPYTEDEIRKILDIRCQEEDVDMSEDAKVLLTKIGVETSLRYAIHLITSAALACQKRKGKVVEMEDITRVYHLFLDVKRSTQYLMEYQSQYMFNEVPREGEDDDAMHS

SEQ ID NO: 15343 - protein, 471 aa, Musa acuminata
MTELKKISEARDLMRIERIGAHSHIRGLGLDAGLEARAVSEGMVGQCAARKSAGLILNLIKEGKIAGRAILLAGQPGTGKTAVAMGLAKSLGPETPFATVFASEIFSLEMSKTEALTQAFRKAIGVRIKEEAEIIEGEVVEISIDRPAAGAGLSAGQSSSKTGKLTLKTTDMETVYELGGKMIEALGKDKVQNGDVIALDRASGKVTKLGRSITRSRDYDATGPSTKFVRCPEGELQKRKEVVHCVTLHEIDVINSRTQGFLALFTGDTGEIRAEVREQIDSKVSEWKEEGKAEIIPGVLFIDEVHMLDIECFSFLNRALENEMAPILVIATNRGITTIRGTNYRSPHGIPADFLDRLLIITTQPYTEEEIGKIIEIRCGEEEVELSKDAKLLLTKIGVETSLRYAIHLITVAALACQKRKGKTVEMEDISRVYQLFLDVKRSTQYLMEYQNQYMFNEVPKAGDEDETMQS

SEQ ID NO: 15344 - protein, 471 aa, Musa acuminata
MAELKKLSEARDLTRIERIGAHSHIRGLGLDAALEARAVSEGMVGQCAARKAAGLILNLIKEGKIAGRAILLAGQPGTGKTAVAMGLAKSLGAETPFAAVSASEIFSLEMSKTEALTQAFRKAIGVRIKEEAEIIEGEVVEISIDRPAAGAGASAGQSSSKTGKLTLKTTDMETVYELGGKMIEALGREKVQSGDVISLDRASGKVTKLGRSITRSRDYDATGPSTKFVRCPEGELQKRKEVVHCVTLHEIDVINSRTQGFLALFTGDTGEIRSEVREQIDSKVSEWKEEGKAEIIPGVLFIDEVHMLDIECFSFLNRALENEMAPILVIATNRGITTIRGTNYRSPHGIPADFLDRLLIVTTQPYTEEEIGKIIEIRCEEEEVEMSKDAKLLLTKIGVETSLRYAIHLITSAALVSLKRKGKMVEMDDISRVYRLFLDVKRSTQYLMEYQNQYMFNEVPSVGEEVESMQS

SEQ ID NO: 15345 - protein, 467 aa, Sesamum indicum
MAEIKLSEMRDLTRIERIGAHSHIRGLGLDSTLEARASSEGMVGQTSARRAAGVIVKMVQEGKIAGRAVLLAGQPGTGKTAIAMGMAKSLGQETPFAMLAGSELFSLEMSKTEALMQAFRKAIGVRIKEETEVIEGEVVEIQIDRPAVAGAASKTGKLTLKTTEMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITSIRGTNYKSPHGIPIDFLDRLLIISTQPYTSDDIRKILDIRCQEEDVEMSEDAKILLTKIGEDTSLRYAINLITSAALACQKRKGKIVEMEDISRVYELFYDVKRSTQYLMEYQSQYMFSEVPDEGGDEDEANAMVS

SEQ ID NO: 15346 - protein, 469 aa, Ocimum basilicum
MAEIKLSEMRDLTRIERIGAHSHIRGLGLDSALEARSSSEGMVGQTSARKAAGVIVKMVQEGKIAGRAVLLAGQPGTGKTAIAMGMAKSIGQETPFAMLAGSELFSLEMSKTEALMQAFRKAIGVRIKEETEVIEGEVVEIQIDRPAVAGAASKTGKLTLKTTDMETVYDLGVKMIEALGKEKVQSGDVIAIDKASGKITKLGRSFSRSRDYDAMGLHTKFVQCPDGELQKRKEVVHCVTLHEIDVINSRTQGFLALFTGDTGEIRAEVREQIDTKVAEWREEGKAEIIPGVLFIDEVHMLDIECFSFLNRALENDMAPILVVATNRGITSIRGTNYRSPHGIPIDFLDRLLIISTQPYTSDDIRKILDIRCQEEDVEMSEDAKVLLTKIGEDTSLRYAINLITSSALACQKRKGKTVEMEDISRVYELFYDVKRSTQYLMEYQSQYMFSEVVTGVGDGEGDEAIAMVS

SEQ ID NO: 15347 - protein, 465 aa, Citrullus lanatus
MAELKLSESRDLTRIERIGAHSHIRGLGLDSSLEPRAVSEGMVGQTAARKAAGVILQMIKEGKIAGRAVLLAGQPGTGKTAIAMGMAKSLGLETPFAMIAGSELFSLEMSKTEALMQAFRKSIGVRIKEETEIIEGEVVEVQIDRPAVAGAASKTGKLTLKTTDMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIISTQPYTEDEIRKILDIRCQEEDVEMSEEAKRLLTTIGVETSLRYAIHLITAAALACQKRKGKIVEMEDINRVYHLFLDVKRSTQYLMEYQNQYMFSELGDAEEDDSNAMNP

SEQ ID NO: 15348 - protein, 465 aa, Lupinus angustifolius
MAELKLSESRDLTRIERIGAHSHIRGLGLDSTLEPRDVSEGMVGQTSARKAAGVILQMIKDGKIAGRAVLIAGQPGTGKTAIAMGMAKSLGLETPFAMIAGSELFSLEMSKTEALTQAFRKAIGVRIKEENEVIEGEVVEVQIDRPSASGAASKSGKLTLKTTEMETVYDLGAKMIEALGKEKVSSGDVIAIDKASGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIISTQPYTEDEIRKILDIRCQEEDVEMSDGAKHLLTKIGGETSLRYAIHLITAAALACQKRKAKVVELEDINRVYHLFLDVKRSTQYLMEYQNQYMFSETGEVDEDDTNAMVS

SEQ ID NO: 15349 - protein, 467 aa, Actinidia deliciosa
  misc_feature (67)..(67): Xaa can be any naturally occurring amino acid
  misc_feature (321)..(322): Xaa can be any naturally occurring amino acid
  misc_feature (455)..(455): Xaa can be any naturally occurring amino acid
  misc_feature (457)..(457): Xaa can be any naturally occurring amino acid
MAELKLSETRDLTRIERIGAHSHIRGLGLDSTLEPRSVSEGMVGQASARKAAGVIVQMVKAGKIAGXAVLLAGHPGTGKTAIAMGMAKSLGLETPFAMLAGSELFSLEMSKTEALTQAFRKAIGVRIKEETEVIEGEVVEIQIDRPASAGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPIXXVATNRGITTIRGTNYKSPHGIPIDFLDRLLIISTQPYTEEEIRKILDIRCQEEDVEMSEDARVLLTKIGVDTSLRYAIHLITSAALACQKRKGKVVEMEDISRVYELFWDVKRSTQYLMEYQSQYMFNEVPTXEXDEDEANAMVS

SEQ ID NO: 15350 - protein, 463 aa, Prunus mume
MAELKLSESRDLTRIERIGAHSHIRGLGLDSALEARDVSEGMVGQTSARKAAGVILQMIKEGKIAGRAVLLAGQPGTGKTAIAMGMAKSLGLETPFAMLAGSELFSLEMSKTEALMQAFRKAIGVRIKEETEVIEGEVVEVQIDRPAVAGAASKTGKLTLKTTEMETVYDLGAKMIEALGKEKVQSGDVIAIDKASGKITKLGRSFSRSRDYDAMGPHIKFMQCPDGELQKRKEVVHCVTLHEIDVINSRTQGFLALFTGDTGEIRSEVREQIDTKVAEWREEGKAEIVPGVLFIDEVHMLDIECFSFLNRALENEMAPILVVATNRGITTIRGTNYKSPHGIPIDLLDRLLIITTQPYTEDEIRKILDIRCQEEEVEMSEEAKHLLTKIGVDASLRYAIHLITASALACQKRKGNIVEMEDINRVYHLFLDVKRSTQYLMEYQSQYMFSEEGDEDDTNAMQS

SEQ ID NO: 15351 - protein, 467 aa, Solanum lycopersicum
MGELKISEMRDLTRIERIGAHSHIRGLGLDSSLEPRLSSEGMVGQIPARKAAGIIVKMVQQGKIAGRALLLAGQPGTGKTAIAMGMAKSLGQETPFAMLAGSELYSLDMSKTEALMQAFRKAIGVRIKEEAEVIEGEVVEVHIDRPAVAGAASKTGKLTLKTTDMETVYDLGAKMIEALGKEKVQSGDVIAIDKASGKITKLGRSFSRSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYRSPHGIPIDFLDRLLIISTQPYKEEEIRKILDIRCQEEDVEMSEDAKVLLTKIGVNTSLRYAIHLITSAALACQKRKGKAVEVEDITRVYNLFYDVKRSTQYLMEYQSQYMFNEVPAGEAEEDETAAMVS

SEQ ID NO: 15352 - protein, 465 aa, Eucalyptus grandis
MAEVKLSETRDLTRIERIGAHSHIRGLGLDSSLEARAVSEGMVGQTAARKAAGVILQMIKDGKIAGRAVLLAGQPGTGKTAIAMGMAKSLGLETPFAMLAGSELFSLEMSKTEALMQAFRKAIGVRIKEEAEVIEGEVVEVQIDRPAVAGAASKTGKLTLKTTEMETVYDLGAKMIEALGKEKVQSGDVVAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIITTQPYTEDEIRKIIDIRCQEEDVEMSEEAKLLLTKIGVDTSLRYAINLITAAALSCQKRKGKIVELEDITRVYNLFLDVKRSTQYLMEYQSQYMFSEFGNAEEDEANVMIS

SEQ ID NO: 15353 - protein, 465 aa, Glycine max
MAELKLSESRDLTRIERVGAHSHIRGLGLDSSLEPRAVSDGMVGQTAARKAAGVILQMIKDGKIAGRAVLLAGQPGTGKTAIAMGMAKSLGLETPFAMIAASEIFSLEMSKTEALTQAFRKAIGVRIKEEAEVIEGEVVEVQIDRPAVSGAAAKTGKLTLKTTEMETVYDLGAKMIEALGKEKVSSGDVIAIDKASGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDLLDRLLIISTQPYTEDEIRKILDIRCQEEDVDMSEGAKCLLTKIGVETSLRYAIHLITAAALACQKQKGKTVELDDINRVYNLFLDVKRSTQYLMEYQSQYMFNETGEADEDEANAMVS

SEQ ID NO: 15354 - protein, 465 aa, Cucumis sativus
MAELKLSESRDLTRIERIGAHSHIRGLGLDSSLEPRAVSEGMVGQTAARKAAGVILQMIKEGKIAGRAVLLAGQPGTGKTAIAMGMAKSLGLETPFAMIAGSELFSLEMSKTEALMQAFRKSIGVRIKEETEIIEGEVVEVQIDRPAVAGAASKTGKLTLKTTDMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIISTQPYTEDEIRKILDIRSQEEEVEMSEEAKRLLTTIGVETSLRYAIHLITAAALACQKRKGKIVEMEDINRVYHLFLDVKRSTQYLMEYQNQYMFSELGDGEEDDSNAMNP

SEQ ID NO: 15355 - protein, 463 aa, Prunus persica
MAELKLSESRDLTRIERIGAHSHIRGLGLDSALEARDVSEGMVGQTSARKAAGVILQMIKEGKIAGRAVLLAGQPGTGKTAIAMGMAKSLGLETPFAMLAGSELFSLEMSKTEALMQAFRKAIGVRIKEETEVIEGEVVEVQIDRPAVAGAASKTGKLTLKTTEMETVYDLGAKMIEALGKEKVQSGDVIAIDKASGKITKLGRSFSRSRDYDAMGPHIKFMQCPDGELQKRKEVVHCVTLHEIDVINSRTQGFLALFTGDTGEIRSEVREQIDTKVAEWREEGKAEIVPGVLFIDEVHMLDIECFSFLNRALENEMAPILVVATNRGITTIRGTNYKSPHGIPIDLLDRLLIITTQPYTEDEIRKILEIRCQEEEVEMSEEAKHLLTKIGVDASLRYAIHLITASALACQKRKGNIVEMEDINRVYHLFLDVKRSTQYLMEYQSQYMFSEEGDEDDTNAMQS

SEQ ID NO: 15356 - protein, 467 aa, Theobroma cacao
MAELKLSESRDLTRIERIGAHSHIRGLGLDSSLEARDVSEGMVGQTQARKAAGVILQMIKDGKIAGRAILLAGQPGTGKTAIAMGMAKSLGLETPFAMLSGSELFSLEMSKTEALMQAFRKSIGVRIKEETEVIEGEVVEIQIDRPAVSGAASKTGKLTLKTTDMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIITTQPYSADEIRKILDIRCQEEDVEMSEDAKQLLTKIGHETSLRYAIHLITASALNCQKRKGKVVEVQDITRVYSLFLDVRRSTQYLMEYQKEYMFNEASMVDGGEDDADAMHD

SEQ ID NO: 15357 - protein, 467 aa, Solanum lycopersicum
MGELKISEMRDLTRIERIGAHSHIRGLGLDSSLEPRLSSEGMVGQIPARKAAGIIVKMVQQGKIAGRALLLAGQPGTGKTAIAMGMAKSLGQETPFAMLAGSELYSLDMSKTEALMQAFRKAIGVRIKEEAEVIEGEVVEVHIDRPAVAGAASKTGKLTLKTTDMETVYDLGAKMIEALGKEKVQSGDVIAIDKASGKITKLGRSFSRSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYRSPHGIPIDFLDRLLIISTQPYKEEEIRKILDIRCQEEDVEMSEDAKVLLTKIGINTSLRYAIHLITSAALACQKRKGKAVEVEDITRVYNLFYDVKRSTQYLMEYQSQYMFNEVPAGEAEEDETAAMVS

SEQ ID NO: 15358 - protein, 467 aa, Manihot esculenta
MAELKLSESRDLTRIERIGAHSHIRGLGLDSALEPRAVSEGMVGQTAARKAAGVILQMIKDGKIAGRAVLLAGQPGTGKTAIAMGMAKSLGLETPFAMISGSEIFSLEMSKTEALMQAFRKAIGVRIKEETEIIEGEVVEVQIDRPAVSGAASKTGKLTLKTTEMETVYDLGAKMIEALGKEKVQSGDVIAIDKASGKITKLGRSFSRSRDYDAMGPQVKFVQCPDGELQKRKEVVHCVTLHEIDVINSRTQGFLALFTGDTGEIRAEVREQIDTKVAEWREEGKADIVPGVLFIDEVHMLDIECFSFLNRALENEMAPILVVATNRGITTIRGTNYKSPHGIPIDLLDRLLIITTQPYTKDDIRKIVDIRCQEEEVEISEEAKALLTHIGVETSLRYAINLITAAALACQRRKGKLVESEDITRVYSLFLDVKRSTQYLMEYQNQYMFNEAPVGNGDEDDASAMLS

SEQ ID NO: 15359 - protein, 468 aa, Papaver somniferum
MAELKLSESRDLTRIERIGAHSHIRGLGLDSALEPRDVSEGMVGQAPARKAAGVILQMIKEGKIAGRAVLLAGQPGTGKTAIAMGMAKSLGQETPFAMMAGSELFSLEMSKTEALMQAFRKSIGVRIKEETEVIEAEVVEVQIDRPAVAGAASKTGKMTLKTTDMETVYDLGAKMIEALGKQKVQSGDVIAIDKSSGKITKLGRSFARSRDYDAMGPQTKFVQCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITNIRGTNYKSPHGIPIDLLDRLLIISTQPYSEDEIRKILDIRSQEEDVEMSDDAKVLLTKIGVEASLRYAIHLITAASLACQKRKGKVVEMEDISRVYQLFLDVKRSTQYLMEYQNQYMFNEVPTREGGDEDDATAVHS

SEQ ID NO: 15360 - protein, 431 aa, Elaeis guineensis
RLSESRDLTRIERIGAHSHIRGLGLDSALEARAVSEGMVGQQSARKAAGLILQLIREGKIAGRAILLAGQPGTGKTAIAMGLAKSLGQETPFATVSGSELFSLEMSKTEALTQAFRRAIGVRIKEEAEIIEGEVIELTIDRPAAAGGGASGSGQSSSASKTGKLTLKTTDMETVYDLGAKMIEALTKEKVQSGDVITLDKASGKVTKLGRSIGRSRDYDAVGPHTKFVRCPEGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPADFLDRLLIICTQPYTEEETRKILDIRCEEEDVEMSKDAKVLLTKIGAETSLRYAINLITAAALACQKRKGKDCWRMEGYK

SEQ ID NO: 15361 - protein, 464 aa, Amborella trichopoda
MAELKLSESRDLTRIERIGAHSHIRGLGLDANLQPRDSSQGMVGQVPARKAAGLILQMIREGKIAGRAVLIAGQPGTGKTAIAMGLAKALGEETPFAMMAGSELFSLEMGKTEALTQAFRKAIGVRIKEETEIIEGEVVELQIDRPATQGAALKTGKLVMKTTEMETVYDLGAKMIESLGRDKVQSGDIIVIDKASGKITKLGRSFNRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITRIRGTNYKSPHGIPIDLLDRLLIISTQPYTEEEIRKILDIRCDEEDVEMSEDAKVLLTKIGVETSLRYAIHLITAASLACQKRKGKLVEMEDISRVYQLFLDVKRSTQYLVEYQNQFMFNEVPGEVDGVETMQV

SEQ ID NO: 15362 - protein, 431 aa, Allium cepa
MASELKKITESHDLTRIERIGAHSHIRGLGLDDSNTPRLIADGMVGQLPARKAAGLILKLIKEGKIAGRAVLLAGQPGTGKTAIAMGLAKSLGQETPFATIAASELFSLEVSKTEALMQAFRKAIGVRIKEEAEVIEGEVVEISIDRPAGGDSKSASKTGKLTMKTTDMETVYELGGKMIESLNKEKVQSGDVIALDKASGKVTKLGRSIGRSRDYDAMGPQTKFVRCPEGELQKRKEVVHCVNLHEIDVINSRTQGFLALFTGDTGEIRSEVREQIDAKVAEWREEGKADVIPGVLFIDEVHMLDIECFSFLNRALENENSPILVIATNRGITTIRGTNYKSPSRDPCRLPRPPPHNIDATVHRGRDTIDPRHQMRGRRRRHEPRRQSAFNQNRGRNLFEVCHPFDHCSCARLSEEEREGGGDGRCEQGL

SEQ ID NO: 15363 - protein, 404 aa, Flaveria ramosissima
MVKEGKIAGRAVLLAGQPGTGKTAIAMGMAKSIGLETPFAMLAGSELFSLEMSKTEALMQAFRKAIGVRIKEETEVIEGEVVEIQIDRPAVTGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIIPGVLFIDEVHMLDIECFSFLNRALENDMAPILVVATNRGITTIRGTNYKSPHGIPIDFLDRLLIISTQPYTEDDIRKILDIRCQEEDVDVSEDAKVLLTKIGVNTSLRYAINLITSAALACQKRKGKVVEMEDVSRVYELFWDVKRSTQYLIEYQSQYMFNEATMAEKMRAL

SEQ ID NO: 15364 - protein, 467 aa, Mimulus guttatus
MAEIKLSEMRDLTRIERIGAHSHIRGLGLDSALEARSSSEGMVGQTSARKAAGVIVKMVQEGKIAGRAVLLAGQPGTGKTAIAMGMAKSIGQETPFAMLAGSELFSLEMSKTEALMQAFRKAIGVRIKEETEVIEGEVVEVQIDRPAVAGAASKTGKLTLKTTEMETVYDLGGKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITSIRGTNYKSPHGIPIDFLDRLLIISTQPYTPEDIRKILDIRCQEEDVEMSEDAKVLLTKIGEDTSLRYAINLITASALACLKRKGRVVEMEDISRVYELFYDVKRSTQYLMEYQSQYMFSEVPAGEGDEDETNAMVS

SEQ ID NO: 15365 - protein, 467 aa, Solanum tuberosum
MGELKISEMRDLTRIERIGAHSHIRGLGLDSSLEPRLSSEGMVGQIPARKAAGIMVKMVQQGKIAGRALLLAGQPGTGKTAIAMGMAKSLGQETPFAMLAGSELYSLDMSKTEALMQAFRKAIGVRIKEEAEVIEGEVVEVQIDRPAVAGAASKTGKLTLKTTDMETVYDLGAKMIEALGKEKVQSGDVIAIDKASGKITKLGRSFARSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYRSPHGIPIDFLDRLLIISTQPYKEEEIRKILDIRCQEEDVEMSEDAKVLLTKIGVNTSLRYAIHLITSAALACQKRKGKAVEVEDITRVYNLFYDVKRSTQYLMEYQSQYMFNEVSAGEAEEDETAAMVS

SEQ ID NO: 15366 - protein, 465 aa, Unknown
  Sequence found in Organisms: Gossypium hirsutum, Gossypium raimondii
MAELKLSESRDLTRIERIGAHSHIRGLGLDSSLEPRDVSEGMVGQAQARKAAGVILQMIKDGKIAGRAILLAGQPGTGKTAIAMGMAKSLGLETPFSMLSGSEIFSLEMSKTEALMQAFRKSIGVRIKEETEIIEGEVVEIQIDRPAVSGAASKTGKLTLKTTDMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITSIRGTNYKSPHGIPIDLLDRLLIITTQPYSEDEIRKILDIRCQEEDVEMSEDAKQLLTKIGHETSLRYAIHLITASALNCQKRKGMVVEVQDITRVYSLFLDVRRSTQYLMEYQKEYMFNEASILDGGDADAMHD

SEQ ID NO: 15367 - protein, 465 aa, Cajanus cajan
MAELRLSESRDLTRIERVGAHSHIRGLGLDSSLSPRAVSEGMVGQVAARKAAGVILQMIREGKIAGRAVLIAGQPGTGKTAIAMGMAKSLGLETPFAMIAGSELFSLEMSKTEALTQAFRKAIGVRIKEETEVIEGEVVEVQIDRPASAAAAAKTGKLTLKTTEMETVYDLGAKMIEALGKEKVSSGDVIAIDKASGKITKLGRSFSRSRDFDAMGPQVKFVQCPDGELQKRKEVVHCVTLHEIDVINSRTQGFLALFTGDTGEIRAEVREQIDTKVAEWKEEGKAEIVPGVLFIDEVHMLDIECFSFLNRALENEMSPILVVATNRGITTIRGTNYKSPHGIPIDLLDRLLIISTQPYTEDEIRKILDIRCQEEDVEMSDGAKHLLTKIGVETSLRYAINLITAAALACQKRKGKTVELDDINRVYNLFLDVKRSTQYLMEYQSQYMFSETGEADEDDTNAMVS

SEQ ID NO: 15368 - protein, 465 aa, Gossypium hirsutum
MTELKLSESRDLTRIERIGAHSHIRGLGLDSSLEPRDVSEGMVGQAQARKAAGVILQMIKDGKIAGRAILLAGQPGTGKTAIAMGMAKSLGLETPFSMLSGSEIFSLEMSKTEALMQAFRKSIGVRIKEETEIIEGEVVEIQIDRPAVSGAASKTGKLTLKTTDMETVYDLGAKMIEALGKEKVQSGDVIAIDKASGKITKLGRSFSRSRDYDAMGPQTKFVQCPDGELQKRKEVVHSVTLHEIDVINSRTQGFLALFTGDTGEIRAEVREQIDTKVAEWREEGKAEIVPGVLFIDEVHMLDIECFSFLNRALENEMAPILVVATNRGITSIRGTNYKSPHGIPIDLLDRLLIITTQPYSEDEIRKILDIRCQEEDVEMSEDAKQLLTKIGHETSLRYAIHLITASALNCQKRKGMVVEVQDITRVYSLFLDVRRSTQYLMEYQKEYMFNEASIVDGGDGDAMHD

SEQ ID NO: 15369 - protein, 467 aa, Solanum phureja
MGELKISEMRDLTRIERIGAHSHIRGLGLDSSLEPRLSSEGMVGQIPARKAAGIMVKMVQQGKIAGRALLLAGQPGTGKTAIAMGMAKSLGQETPFAMLAGSELYSLDMSKTEALMQAFRKAIGVRIKEEAEVIEGEVVEVQIDRPAVAGAASKTGKLTLKTTDMETVYDLGAKMIEALGKEKVQSGDVIAIDKASGKITKLGRSFARSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYRSPHGIPIDFLDRLLIISTQPYKEEEIRNILDIRCQEEDVEMSEDAKVLLTKIGVNTSLRYAIHLITSAALACQKRKGKAVEVEDITRVYNLFYDVKRSTQYLMEYQSQYMFNEVSAGEAEEDETAAMVS

SEQ ID NO: 15370 - protein, 465 aa, Echinacea purpurea
MVEVKVSETRDLTRIERIGAHSHIRGLGLDSALEPRAVSEGMVGQTTARKAAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVSGAASKTGKLTLKTTEMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYTEDDIRKILDIRCQEEDVDVSEDAKVLLTKIGVDTSLRYAINLITSAALACQKRKGKAVEMEDVSRVYELFWDVKRSTQYLIEYQSQYMFNEATMGEEEDEGHMMV

SEQ ID NO: 15371 - protein, 465 aa, Gossypium raimondii
MAELKLSESRDLTRIERIGAHSHIRGLGLDSSLEPRDVSEGMVGQAQARKAAGVILQMIKDGKIAGRAILLAGQPGTGKTAIAMGMAKSLGLETPFSMLSGSEIFSLEMSKTEALMQAFRKSIGVRIKEETEIIEGEVVEIQIDRPAVSGAASKTGKLTLKTTDMETVYDLGAKMIEALGKEKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITSIRGTNYKSPHGIPIDLLDRLLIITTQPYSEDEIRKILDIRCQEEDVEMSEDAKQLLTKIGHETSLRYAIHLITASALNCQKRKGMVVEVQDITRVYSLFLDVRRSTQYLMEYQKEYMFNEASIVDGGDADSMHD

SEQ ID NO: 15372 - protein, 465 aa, Arachis hypogaea
MAELKLSESRDLTRIERIGAHSHIRGLGLDSSLEPRAVSEGMVGQTSARKAAGVILQMIRDGKIAGRAVLLAGQPGTGKTAIAMGMAKSLGLETPFAMIAGSELFSLEMSKTEALTQAFRKAIGVRIKEETEVIEGEVVEVQIDRPAVAGAASKSGKLTLKTTEMETVYDLGAKMIEALGKEKVTSGDVIAIDKASGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITNIRGTNYKSPHGIPIDLLDRLLIISTQPYTEEEIRKILDIRCQEEDVEMAEGAKQLLTKIGVETSLRYAIHLIIAAALACQKRKGKVVELEDINRVYHLFLDVKRSTQYLMEYQNQYMFNETGEGEEDDVHATVF

SEQ ID NO: 15373 - protein, 465 aa, Ambrosia trifida
MVELKVSESRDLTRIERIGAHSHIRGLGLDSALEPRASSEGMVGQTKARKAAGVIVQMVKEGKIAGRAVLLAGQPGTGKTAIAVGMAKSIGLETPFAMLAGSELFSLEMSKTEALMQAFRKAIGVRIKEETEVIEGEVVEIQIDRPAVTGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYTEDDIRKILDIRCQEEDVDVSEDAKVLLTKIGVDTSLRYAINLITSASLACQKRKGKVVEMEDVSRVYELFWDVKRSTQYLIEYQSQYMFNEATMGEEDEGNLMVS

SEQ ID NO: 15374 - protein, 465 aa, Glycine max
MAELKLSESRDLTRIERVGAHSHIRGLGLDSSLEPRAVSDGMVGQTAARKAAGVILQMIKDGKIAGRAVLLAGQPGTGKTAIAMGMAKSLGLETPFAMIAASEIFSLEMSKTEALTQAFRKAIGVRIKEETEVIEGEVVEVQIDRPAVAGAAAKTGKLTLKSTEMETVYDLGAKMIEALGKEKVSSGDVIAIDKASGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIISTQPYTEDEIRKILDIRCQEEDVDMSEGAKCLLTKIGVETSLRYAIHLITAAALACQKRKGKTVELDDINRVYNLFLDVKRSTQYLMEYQSQYMFNETGEADEDETNAMVS

SEQ ID NO: 15375 - protein, 464 aa, Cirsium arvense
MVELKVSESRDLTRIERIGAHSHIRGLGLDSALEPRAVSEGMVGQTTARKGAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVAGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYSEEEIRKILDIRCGEEDVEVSEDAKVLLTKIGVETSLRYAINLITSASLSCQKRKGKVVEMEDVSRVYELFWDVKRSTQYLMEYQSQYMFSEAATMEDEEANMMV

SEQ ID NO: 15376 - protein, 462 aa, Fragaria vesca
MAELKLSESRDLTRIERIGAHSHIRGLGLDSALEARDVSEGMVGQTAARKAAGVILQMIKEGKIAGRAVLLAGQPGTGKTAIAMGMAKSLGLETPFAMLAGSELFSLEMGKTEALMQAFRKAIGVRIKEETEIIEGEVVEVQIDRPAVAGAASKTGKLTLKTTEMETVYDLGAKMIEALGKEKVQSGDVVAIDKASGKITKVGRSFSRSRDYDAMGPSVKLVQCPDGELQKRKEVVHCVTLHEIDVINSRTQGFLALFTGDTGEIRSEVREQIDTKVAEWREEGKAEIVPGVLFIDEVHMLDIECFSFLNRALENEMAPILVVATNRGITTIRGTNYKSPHGIPIDLLDRLLIITTQPYTEDEIRKILDIRSQEEEVEMSEEAKHLLTKIGVDASLRYAIHLITAAALACQKRKGKIVEMEDINRVYHLFLDVKRSTQYLMEYQSQYMFNDADEDDANAMQP

SEQ ID NO: 15377 - protein, 169 aa, Flaveria ramosissima
MVELKVSESRDLTRIERIGAHSHIRGLGLDSALEPRAVSEGMVGQTTARKAAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVTGAASKNREVDVEDDRDGDSV

SEQ ID NO: 15378 - protein, 467 aa, Manihot esculenta
MAELKLSESRDLTRIERIGAHSHIRGLGLDSALEPRAVSEGMVGQTAARKAAGVILQMIKDGKIAGRAVLLAGQPGTGKTAIAMGMAKSLGLETPFAMISGSEIFSLEMSKTEALMQAFRKAIGVRIKEETELIEGEVVEVQIDRPAVAGAASKTGKLTLKTTEMETVYDLGAKMIEALGKEKVQSGDVIAIDKASGKITKLGRSFSRSRDYDAMGPQVKFVQCPDGELQKRKEVVHCVTLHEIDVINSRTQGFLALFTGDTGEIRAEVREQIDTKVAEWREEGKADIVPGVLFIDEVHMLDIECFSFLNRALENEMAPILVVATNRGITAIRGTNYKSPHGIPIDLLDRLLIITTQPYTKDEISKIVDIRCQEEEVEISEEAKALLTHIGVETSLRYAINLITAAALACHRRKGKLVESEDVTRVYNLFLDVKRSTQYLMEYQNQYMFNEVPVGDGDEDDPSAMLS

SEQ ID NO: 15379 - protein, 168 aa, Tabernaemontana elegans
MLDIECFSFLNRALENDMAPILVVATNRGITTIRGTNYKSPHGIPIDFLDRLLIISTQPYTEEEIRKILDIRCQEEDVEMSEDAKVLLTKIGVDTSLRYAIHLITASALACQKRKGKVVEMEDISRVYELFYDVKRSTQYLMEYQSQYMFNEVPTAEGDEDDATAMVS

SEQ ID NO: 15380 - protein, 462 aa, Helianthus annuus
MVELKVSESRDLTRIERIGAHSHIRGLGLDSALEPRASSEGMVGQTTARKAAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVTGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYTEEDIRKILDIRCQEEDVDVSEDAKVLLTKIGVDTSLRYAINLITSAALACQKRKGKVVEMEDVSRAYELFWDVKRSTQYLIEYQRDYMFSEGTMGEEDEMVS

SEQ ID NO: 15381 - protein, 272 aa, Flaveria ramosissima
MVELKVSESRDLTRIERIGAHSHIRGLGLDSALEPRAVSEGMVGQTTARKAAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVTGAASKTGKLTLKTTEMETVYDLGAKMIEALGKDKVQSGDVIAIDKASGKITKLGRSFSRSRDYDAMGHKRSSCSVLMASCRRGKRWCIVLHFMKLMLSIAEHKGFLLFSRATLVKFELRSENK

SEQ ID NO: 15382 - protein, 468 aa, Aquilegia formosa
MAEIKLSESRDLTRIERIGAHSHIRGLGLDSALEARVVSEGMVGQTKARKAAGIILQMIKQGKIAGRAILLAGQPGTGKTAIAMGMAKSLGEETPFAMMAGSELFSLEMSKTEALKQAFRKAIGVRIKEETEIIEGEVVEIQIDRPAVTGVASKTGKLTLKSTDMETVYDLGAKMIEALGKQKIQSGDVIAIDKASGKITKLGRSFARSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDLLDRLLIISTEPYTKEEIRKILDIRSQEEDVEMSEDAKVLLTRIGVEASLRYAIHLITAAALACQKRKGKIVEIEDISRVYQLFLDVKRSSQYLTEYQSQYMFSETPLKEGDDEEETTAMHS

SEQ ID NO: 15383 - protein, 465 aa, Gossypium raimondii
MTELKLSESRDLTRIERIGAHSHIRGLGLDSSLEPRDVSEGMVGQAQARKAAGVILQMIKDGKIAGRAILLAGQPGTGKTAIAMGMAKSLGLETPFSMLSGSEIFSLEMSKTEALMQAFRKSIGVRIKEETEIIEGEVVEIQIDRPAVSGAASKTGKLTLKTTDMETVYDLGAKMIEALGKEKVQSGDVIAIDKASGKITKLGRSFSRSRDYDAMGPQTKFVQCPDGELQKRKEVVHSVTLHEIDVINSRTQGFLALFTGDTGEIRAEVREQIDTKVAEWREEGKAEIVPGVLFIDEVHMLDIECFSFLNRALENEMAPILVVATNRGITSIRGTNYKSPHGIPIDLLDRLLIITTQPYSEDEIRKILDIRCQEEDVEMSEDAKQLLTKIGHETSLRYAIHLITASALNCRKRKGMVVEVQDITRVYSLFLDVRRSTQYLMEYQKEYMFNEASIVDGGDADAMHD

SEQ ID NO: 15384 - protein, 469 aa, Lotus japonicus
MAELKLSESRDLTRIERVGAHSHIRGLGLDSSLEPRDVSEGMVGQVSARKAAGVILQMIKDGKIAGRAVLLAGQPGTGKTAIAMGMAKSLGLETPFAMIAGSELFSLEMSKTEALTQAFRKAIGVRIKEETEVIEGEVVEVNIDRPSVSGAAAKTGKLTLKTTEMETVYDLGAKMIEALGKEKVTGGDVIAIDKASGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMSPILVVATNRGITTIRGTNYKSPHGIPIDLLDRLLIISTQPYTEDDIRKILDIRCQEEDVDLTEGAKRLLTKIGVETSLRYAIHLITAAALACLKRKGKTVELEDINRVYNLFLDVKRSTQYLMEYQSQYMFSETGEVDEDDANVNANAMVS

SEQ ID NO: 15385 - protein, 464 aa, Centaurea maculosa
MVEVKVSESRDLTRIERIGAHSHIRGLGLDSALEPREVSEGMVGQTTARKGAGVIVQMVKEGKIAGRAVLLAGQPGTGKTAIAMGMAKSIGLETPFAMMAGSELFSLEMSKTEALMQAFRKAIGVRIKEETEVIEGEVVEIQIDRPAVAGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIIPGVLFIDEVHMLDIECFSFLNRALENDMAPILVVATNRGITTIRGTNYKSPHGIPIDFLDRLLIISTQPYSEEEIRKILDIRCGEEDVDVSEDAKVLLTKIGVETSLRYAINLITSASLACQKRKGKVVEMEDVSRVYELFGDVKRSTQYLMEYQSQYMFSEGATMEDDETNMMV

SEQ ID NO: 15386 - protein, 467 aa, Chenopodium quinoa
MAELKLSESKDLTRIERIGAHSHIRGLGLDSTLEPRLTSEGLVGQLPARKAAGVILQMIKDGKIAGRGVLIAGQPGTGKTAIAMGLAKSLGHETPFAMLSGSEIFSLEMSKTEALMQAFRRAIGVRIKEEAEVIEGEVVEIQVDRPAVAGAASKTGKLTLKTTDMETVYDLGTKMIEALSKEKVQSGDVIAIDKASGKITKLGRSFSRSRDYDAMGPHTKFVQCPDGELQKRKEVVHCVTLHEIDVINSRTQGFLALFTGDTGEIRAEVREQIDTKVAEWREEGKAEIVPGVLFIDEVHMLDVECFSFLNRALENEMAPILVVATNRGHTRIRGTNYRSPHGMPIDLLDRLLIIATQPYTEEEIRKILEIRCQEEDVEMTEEAKVLLTKIAMETSLRYAINLINSSALACQRRKAKSVEMEDVSRVYQLFLDVKRSTQYLMEYQNQYMFNAVPGVEVNEDENADMIA

SEQ ID NO: 15387 - protein, 463 aa, Abies balsamea
MAELKLSETRDLTRIERIGAHSHIRGLGLDDALEARKVSQGMVGQTSARKAAGVILEMIKEGKIAGRAVLLAGQPGTGKTAIAMGMAKSLGEETPFAMMAGSEIFSLDMSKTEALTQAFRKAIGVRIKEETEIIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTQPYTEDELHQILDIRCEEEDVEMSEDAKELLTKIGAETSLRYAIQLITAAALACQKRKGKLVELEDVSRVYQLFVDIKRSTQFLMEYQEQFMFNEVPGDIEEDTMAE

SEQ ID NO: 15388 - protein, 463 aa, Pinus pinaster
MAELKLSETRDLTRIERIGAHSHIRGLGLDDALEARKVSQGMVGQTSARKAAGVILEMIKEGKIAGRAVLLAGQPGTGKTAIAMGMAKSLGEETPFAMMAGSEIFSLDMSKTEALTQAFRKAIGVRIKEETEIIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTQPYMEDEMRQILDIRCEEEDVEMSDDAKELLTKIAVETSLRYAIHLITAAALACQKRKGKFVELEDVSRVYQLFVDIKRSTQFLMEYQEQFMFNEVPGEIEEDNMVV

SEQ ID NO: 15389 - protein, 464 aa, Quercus alba
MVEVKLSESRDLTRIERIGAHSHIRGLGLDSSLEPREVSEGMVGQTSARKAAGVILQMIRDGKIAGRAVLLAGQPGTGKTAIAMGMAKSLGLETPFAMLAGSELFSLEMSKTEALMQAFRKAIGVRIKEEAEVIEGEVVEIQIDRPAVAGAASKTGKLTLKTTEMETVYDLGAKMIEALAKEKVQSGDVIAIDKASGKITKLGRSFSRSREYDAMGPQTKFVQCPDGELQKRKELVHSVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIITTKPYTEDEIRKILDIRCQEEDVEMSEEAKRLLTKIGVETSLRYAIHLITAAALSCQKRKGRIVEMEDINRVYHLFLDVKRSTQYLMEFQNQYINETADGDEEDANAMES

SEQ ID NO: 15390 - protein, 463 aa, Pinus taeda
MAELKLSETRDLTRIERIGAHSHIRGLGLDDALEARKVSQGMVGQTSARKAAGVILEMIKEGKIAGRAVLLAGQPGTGKTAIAMGMAKSLGEETPFAMMAGSEIFSLDMSKTEALTQAFRKAIGVRIKEETEIIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTQPYMEDEMRQILDIRCEEEDVEMSDDAKELLTKIAVETSLRYAIHLITAAALACQKRKGKFVELEDVSRVYQLFVDIKRSTQFLMEYQEQFMFNEVPGEIEEDNMAV

SEQ ID NO: 15391 - protein, 463 aa, Pseudotsuga menziesii
MVELKLSETRDLTRIERIGAHSHIRGLGLDDALEARKVSQGMVGQTSARKAAGVILEMIKEGKIAGRAVLLAGQPGTGKTAIAMGMAKSLGEETPFAMMAGSEIFSLDMSKTEALTQAFRKAIGVRIKEETETIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTKPYTEDEMHQILDIRCEEEDVEMSEDAKELLTKIGVETSLRYAIHLITAAALACQKRKGKLVELEDVSRVYQLFVDVKRSTQFLMEYQEQFMFNEVPGEIEEDTMVE

SEQ ID NO: 15392 - protein, 463 aa, Picea glauca
MAELKLSETRDLTRIERIGAHSHIRGLGLDDALEARKVSQGMVGQTSARKAAGVILEMIKEGKIAGRAVLLAGQPGTGKTAIAMGMAKSLGEETPFAMMAGSEIFSLDMSKTEALTQAFRKAIGVRIKEETEIIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTQPYTEDEMHQILDIRCEEEDVEMSDDAKELLTKIGVETSLRYAIHLITAAALACQKRKGKFVELKDVSRVYQLFVDIKRSTQFLMEYQEQFMFNEVPGEIEEDIMAV

SEQ ID NO: 15393 - protein, 462 aa, Lactuca sativa
MVEVKVSESKDLTRIERIGAHSHIRGLGLDSALEPRAVSEGMVGQTTARKAAGVIVQMVKEGKIAGRAVLLAGQPGTGKTAIAMGMAKSIGLETPFAMLAGSELFSLEMSKTEALMQAFRKAIGVRIKEETEVIEGEVVEIQIDRPAVAGAASKTGKLTLKTTEMETVYDLGAKMIEALGKDKVQSGDVIAIDKASGKITKLGRSFSRSRDYDAMGPQTKFVQCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYTEEDIRKILDIRCGEEDVDVAEDAKVLLTKIGVETSLRYAINLITSAALACQKRKGKVVEMEDVSRVYELFWDVKRSTQYLMEYQSQYMFSDAPEEDEVNMMV

SEQ ID NO: 15394 - protein, 467 aa, Nicotiana benthamiana
MAEVKISEMRDLTRIERIGAHSHIRGLGLDSSLEPRLSSEGMVGQTSARKAAGVIVKMVQEGKIAGRAVLLAGQPGTGKTAIAMGMAKSLGQETPFAMLAGSELYSLEMSKTEALMQAFRKAIGVRIKEEAEVIEGEVVEVQIDRPAVAGAASKTGKLTLKTTDMETVYDLGGKMIEALGKEKVQSGDVIAIDKASGKITKLGRSFSRSRDYDAMGPQTKFVQCPEGELQKRKEIVHCVTLHEIDVINSRTQGFLALFTGDTGEIRAEVREQIDTKVAEWREEGKAEIVPGVLFIDEVHMLDIECFSFLNRALENDMAPILVVATNRGITTIRGTNYKSPHGIPIDFLDRLLIISTQPYKEEEIRKILDIRCQEEDVEMSEDAKILLTKIGVNTSLRYAIHLITSAALACQKRKGKIVEVDDVTRVYNLFYDVKRSTQYLMEYQSQYMFNEVPTGDAEEDETTAMVC

SEQ ID NO: 15395 - protein, 466 aa, Unknown
  Sequence found in Organisms: Citrus clementina, Citrus sinensis
MAELKLSESRDLTRIERIGAHSHIRGLGLDSSLEARDVSEGMVGQLPARKAAGVILQMIKEGKIAGRAVLIAGQPGTGKTAIAMGMAKSLGLETPFAMISGSEIFSLEMSKTEALMQAFRKAIGVRIKEEAEVIEGEVVEVQIDRPATSGAAAKTGKLTLKTTEMETVYDLGGKMIEALGKEKVQSGDVIAIDKVSGKITKLGRSFSRSRDYDAMGPHTKFVQCPDGELQKRKEVVHCVTLHEIDVINSRTQGFLALFTGDTGEIRAEVREQIDTKVAEWREEGKAEIVPGVLFIDEVHMLDVECFSFLNRALENEMAPILVVATNRGITRIRGTNYKSAHGIPMDLLDRLLIISTKPYTRDEIRKILDIRCQEEDVEMAEDAKQLLTRVGEGTSLRYAIHLITAAALASQKRKGKVVEVQDIDRVYRLFLDVQRSTQYLMEYQSQYINEVTIEADEDDANAMVPE

SEQ ID NO: 15396 - protein, 467 aa, Vinca minor
MAEVKISETRDLTRIERIGAHSHIRGLGLDSGLEPRAVSEGMVGQSTARKAAGIIVKMVQDGKIAGRAVLLAGQPGSGKTAIAMGVAKSIGQETPFAMLAGSELFSLEMSKTEALMQAFRKAIGVRIKEETEVIEGEVVEVQIDRPAVAGAASKTGKLTLKTTEMETVYDLGAKMIEALGKEKVQSGDVIAIDKASGKISKLGRSFSRSRDYDAVGPHTKFVQCPDGELQKRKEIMHCVTLHEIDVINSRTQGFLALFTGDTGEIRAEVREQIDTKVAEWREEGKAEIVPGVLFIDEVHMLDIECFSFLNRALENDMAPILIVATNRGFPKIRGTNYKSAHGIPTDFLDRLLIIHTQPYTEDEIRKILDIRCQEEDVEMSEDAKVLLTKIGVDTSLRYAINLITAAALSCQKRKGKVVEMEDISRVYELFYDVKRSTQYLMEYQSQYMFSEVPTTEGDEDETTAMVS

SEQ ID NO: 15397 - protein, 259 aa, Catharanthus roseus
MAELKISEMRDLTRIERIGAHSHIRGLGLDSALEPRAVSEGMVGQTSARKAAGVIVKMVQEGKIAGRAVLLAGQPGSGKTAIAMGMAKSLGQETPFAMLAGSELFSLEMSKTEALMQAFRKAIGVRIKEETEVIEGEVVEIQIDDQLLLSSIQDWEIALKTTEMETVYDLGAKMIEALGKEKVQSGDVIAIDKASGKISKLGRSFSRSRDYDAVGPHTKFVQCPDGELQKRKEIVHCVTLHEIDVINSRTQGVSGSLYR

SEQ ID NO: 15398 - protein, 463 aa, Picea glauca
MAELKLSETRDLTRIERIGAHSHIRGLGLDDALEARKVSQGMVGQTSARKAAGVILEMIKEGKIAGRAVLLAGQPGTGKTAIAMGMAKSLGEETPFTMMAGSEIFSLDMSKTEALTQAFRKAIGVRIKEETEIIEGEVVEIQIDRPATSGAAAKTGKLTLKTTEMETVYDLGSKMIEGLSKEKVQSGDVIAIDKASGKITKLGRSFARSRDYDAMGPQTKFVQCPDGELQKRKEVVHCVTLHEIDVINSRTQGFLALFTGDTGEIRSEVREQIDSKVAEWREEGKAEIVPGVLFIDEVHMLDIECFSFLNRALENEMAPILVVATNRGITKIRGTNYKSPHGIPIDLLDRLLIISTQPYTEDELHQILDIRCEEEDVEMSDDAKELLTKIGVETSLRYAIHLITAAALACQKRKGKFVELKDVSRVYQLFVDIKRSTQFLMEYQEQFMFNEVPGEIEEDIMAV

SEQ ID NO: 15399 - protein, 465 aa, Phaseolus vulgaris
MAELKLSESRDLTRIERVGAHSHIRGLGLDSSLEPRAVSEGMVGQTAARKAAGVILRMIKDGKIAGRAVLLAGQPGTGKTAIAMGMAKSLGLETPFAMIAASEIFSLEMSKTEALTQSFRKAIGVRIKEDTEVIEGEVVEVHIDRPAAAGAASKTGKLTLKTTEMETVYDLGAKMIEALGKEKVSSGDVIAIDKATGKITKLGRSFSRSRDFDAMGPQVKFVQCPDGELQKRKEVVHCVTLHEIDVINSRTQGFLALFTGDTGEIRAEVREQIDTKVAEWREEGKAEIVPGVLFIDEVHMLDIECFSFLNRALENEMAPILVVATNRGITTIRGTNYKSPHGIPIDLLDRLLIISTQPYTEDEIRKILDIRCQEEEVEMTESAKHLLTKIGVETSLRYAIHLITAAALACQKRKGKAVELEDINRVYNLFLDVKRSTQYLMEYQSQYMFSDTGEADEDETNAMVS

SEQ ID NO: 15400 - protein, 380 aa, Trifolium pratense
MTELKLSETRDLTRIERVGAHSHIRGLGLDSSLEPRDVSEGMVGQVSARKAAGVILQMIKDGKIAGRAVLLAGQPGTGKTAIAMGMAKSLGLETPFAMIAGSELFSLEMSKTEALTQAFRKAIGVRIKEETEVIEGEVVEVQIDRPAVSGAAAKTGKLTLKSTEMETVYDLGAKMIEAIGKEKITSGDVIAIDKASGKITKLGRSFSRSRDFDAMGPQVKFVQCPDGELQKRKEVVHCVTLHEIDVINSRTQGFLALFTGDTGEIRAEVREQIDTKVAEWKEEGKAEIVPGVLFIDEVHMLDIECFSFLNRALENEMSPILVVATNRGITTIRGTNYKSPHGIPIDLLDRLLIISTQPYTEDEIRKILDIRCPRGRRRHE

SEQ ID NO: 15401 - protein, 218 aa, Capsicum annuum
MGEVKISEMRDLTRIERIGAHSHIRGLGLDNNLEPRLSSEGMVGQTSARKAAGVIVRMVQQGKIAGRAVLLAGQPGTGKTAIAMGMAKSLGIETPFAMLAGSELYSLDMSKTEALMQAFRKAIGVRIKEEAEVIEGEVVEVQFDRPTVSGAASKTGKLTLKTTDMETVYDLGAKMIEALGKEKVQSGDVIAIDKASGKITKLGRSFSRSRDYDAWGRS

SEQ ID NO: 15402 - protein, 465 aa, Cicer arietinum
MTELKLSESRDLTRIERVGAHSHIRGLGLDSSLEPRDVSEGMVGQASARKAAGVILQMIKDGKIAGRAVLLAGQPGTGKTAIAMGMAKSLGLETPFAMIAGSELFSLEMSKTEALTQAFRKAIGVRIKEETEVIEGEVVEVQIDRPAVSGAAAKTGKLTLKSTEMETVYDLGAKMIEAIGKEKVTSGDVIAIDKASGKITKLGRSFSRSRDFDAMGPQVKFVQCPDGELQKRKEVVHCVTLHEIDVINSRTQGFLALFTGDTGEIRAEVREQIDTKVAEWKEEGKAEIVPGVLFIDEVHMLDIECFSFLNRALENEMSPILVVATNRGITTIRGTNYKSPHGIPIDLLDRLLIIHTQPYTEDEIRKILDIRCQEEDVDMSEGAKHLLTKIGVETSLRYAIHLITAAALACQKRKGKTVELDDINRVYNLFLDVKRSTQYLMEYQSQYMFSETGEVEEDDANAMVA

SEQ ID NO: 15403 - protein, 465 aa, Gossypium hirsutum
MTELKLYESRDLTRIERIGAHSHIRGLGLDSSLEPRDVSEGMVGQAQARKAAGVILQMIKDGKIAGRAILLAGQPGTGKTAIAMGMAKSLGLETPFSMLSGSEIFSLEMSKTEALMQAFRKSIGVRIKEETEIIEGEVVEIQIDRPAVSGAASKTGKLTLKTTDMETVYDLGAKMIEALAKEKVQSGDVIAIDKASGKITKLGRSFSRSRDYDAMGPQTKFVQCPDGELQKRKEVVHSVTLHEIDVINSRTQGFLALFSGDTGEIRAEVREQIDTKVAEWREEGKAEIVPGVLFIDEVHMLDIECFSFLNRALENEMAPILVVATNRGITSIRGTNYKSPHGIPIDLLDRLLIITTQPYSEDEIRKILDIRCQEEDVEMSEDAKQLLTKIGHETSLRYAIHLITASALNCQKRKGMVVEVQDITRVYSLFLDVRRSTQYLMEYQKEYMFNEASIIDGGDADSMHD

SEQ ID NO: 15404 - protein, 400 aa, Elaeis guineensis
MATGSILEAPVLLREPSKFRPRPNPFFHKFQSRLPLSLPTSHKFIRVSIQSVPNPMVAIRPCAAAAYSSLEERNKFARAVLETLRALRKSAIAVIFLGFLLTADPLPALAASGGRMGGSAFSSSSRSHSSSSSSRSHSSSSLHSYSRPSISSFSYSVPYYAPSPFGAGGGLVRAVGVGFNSEGGFILLMFCFAAVILLAGIISDQRDGGSVLADTQKTSVLKLQVGLLGMARSLQKDLDRIAETADTSTPEGLSYVLTETTLALLRHPDCCISAYSSVDVKRTIEGGEKRFNKLSIEERGKFDEETLVNVNNIKRRKTTSQRSKGFSNEYIVITILVAAEGVYKLPVINGSADLKEALQKLASIPSRKTLAVEVLWTPQNENDALSERELLEDYPLLRPL

SEQ ID NO: 15405 - protein, 389 aa, Musa acuminata
MVSASLLETISVFREPPKCRPQRLLRWNPILQPPLPQFPLIRSRKPIRFALGCSPRPPSAAAGDEQKRRPLDAALRAVLETLDRLKKPAAAIILIGFLLTADSHGALAASGGRMGGKAFSSSPSRSHSSSSWSYSAPPSSRFSYSAPYYAPSPFGGGFYAGPAFGVGFGAGSGFFLLMMGFAAVILLSGFLSDRADDGSVLTATQKTSVIKLQVGLLGIARSFQKDLDQIAEAADTSTPEGLNYILTETTLALLRRPDCCISAYSSVDVKRSIEDGEKRFNQLSIEERGKFDEETLVNVNNIRRQKTGNQTFRSFSNEYIVVTILVAAEGVYKLPVINGSGDLKEALQKLGSIPSSKTLAVEVLWTPQNENDTLSERELLEDYPLLRPL

SEQ ID NO: 15406 - protein, 400 aa, Eucalyptus grandis
MATAATLFLFQPRLPGSGRKSPPCLPGARRARLGTRAPSFGPESVRGRRGVAGCSARRGDPPAAAPSAASGSGAEDRPRNPLEVVLSAVARALESLKRPAVAAILLGLLLAYDPNSALAASGGRMGGSSFSSSRSSSSSSSSSRSYTTRAPSPSIPYSAPYYAPSPFGGAYVGPAVGVGVGAGSSFFLIFMGFAAFLLVSGFLSDRSEGGVLTATEKTTVLKLQVGLLGMGRSLQRDLNKIADVADTSSSQGLSYVLTETTLALLRHPDYCISGYSSVDVKRSMEDGEKRFNQLSIEERGKFDEETLVNVNNIRKQSTTSQRSSGFSNEYIVITILVAAEGVHKLPSINGGGDLKEALQKLGSIPSSKILAVEVLWTPQNENDTLSERELLEDYPLLRPL

SEQ ID NO: 15407 - protein, 392 aa, Phalaenopsis aphrodite
MYSVSLLEAISIIRDSPRNRLPSQKWNPLFHRRVSEGFVRNPRTTRFCTHLALKPIATQRVSSPDASEEEGNPWDGFVTKVFDALKALKKPAIAALLVGVLLTVDPFRAIAASGGRMGGRAFSSSSSSPSYSRSYSAPPSSGFSYSVPYYAPSPFGAAGGFYVGPVVGVGFGAGSGLFILMMGFAAFVLLTGFLSDRSDEGSVLTAEQKTSVLKLQVGLLGMARSLQKDLNRIAETADTSTAEGLNYVLTETALALLRHPDCCISAYSSVDVKRSVEDGEKRFNQLSIEERGKFDEETLVNVNNIKRQRTTSYSSRSFSNEYIVITILVAAEGLHKLPVINSSADLMTALQKLGSIPVNKTMAVEVLWTPQNEDDTLSERELLEDYPLLRPL

SEQ ID NO: 15408 - protein, 1630 aa, Cicer arietinum
MAPKSGKGKTNKAKAEKKKKEEKAVAPSLVDITIVTPYDSQIVLKGISTDKILDVRKLLAVKVETCHFTNYSLSHEVKGRRLNDKVEVVTLKPCVLRMVEENYYEEVQAVTHVRRLLDIIACTTRFGKPKRTITGPESKPKKNGKAQNQNKSSVSPPATPNGDSRVGLPSSDPPASPISDNVGMVAIHPTPKLSDFYEFFSFSHLTPPILHLKKCETKDEDDRRKGDYFQLQVKISNGKMIEVVASEKGFYSVGKLSLQSHTLVDLLQQLSRGFSNAYGSLMKAFSDRNKFGNLPYGLRSNTWLVPPSVGESLSNFPALPAEDENWGGNGGGQGRNRAYDLRPWATDFAILASLPSKTEEERVIRDRKAFLLHSQFVDTSIFKAAAAIQHVMESKSSKKNEMNSVLHQDQVGDLLIVVKHDGNGKFDSTLNEPSKQNEHVQKNLIKGLSADESVTVNDTSSLTVVVVNHCGYTATVKVVGNANAKKPKVQDIEIDDQPDGGANALNINSLRVLLHKSGAEFSEGTLTSLSNFDDLDASKDLVRKVVEEWTEKIKEEPSVSERSIRWELGSSWMQHLQKQETSTDVGSDNKNGNVEQAVKGLGNQFKFLKKREKKASELDGTDSREPNNDELSSSNELETLLSKEAFSRIKESGSGLHLKSVDELINMAHKFYDEVALPKLVTDFGSLELSPVDGRTLTDFMHLRGLKMGSLGEVVKLAENLPHIQSLCIHEMITRAFKHLLKAVIASVNNVADLPSVIASTLNFLLGGCRTEDTDQTSGDDHRLKIHWLRSFLSQRFGWTLKDEFQHLRKLSILRGLCHKVGLELFPRDYDMESPKPFGKYDIISLVPVCKHVGCSSIDGRNLLESSKIALDKGKLEDAVSYGTKALAKMMAVCGPYHRNTASAYSLLAVVLYHTGDFNQATIYQQKALDINERELGLDHPDTMKSYGDLSVFYYRLQHIELALKYVNRALFLLHFTCGLSHPNTAATYINVAMMEEGMGNVHVALRYLHEALKCNKRLLGADHIQTAASYHAIAIALSLMEAYSLSVQHEQTTLKILQAKLGAEDLRTQDAAAWLEYFESKAIEQQEAAKNGTPKTDTSIASKGHLSVSDLLDFISPDNDSKGNDAQRKQRRPKILPISDNNGQEHDDAAAIADDGVLVDNVKDVKTTVEGNVNETNATHDSDEPKDIGGDLSRHKPVTSEAVYETSSDEGWQEANSKGRSGNGANRKSGRRQRPNLSKLSIHKETSYRNDTTSLPQKGAPKVTSALLSPSRQSKTSKALLSSKISSSPASLSSLASKSISYKEVAVAPPGTVLKPLLEKTEVEKVNDENETQKQEASIEKSIAEAVQQQDEKEVIHDESEKESSASELEKVSLSSDQTKPTETNGSKLSAAAKPFSPGTLSASRHLNPVPVASIYDANGSQGILVEPVLPPAAARVPCGPRSPLYYRTNYTFRMKHGSSKIREISGSGGPRIMNPHAPEFVPRSASQIETSDANSNVSSDENKSSPSKHSLSESEKSEIARQILLSFLVKSVHQNADAVDEAKITEGEVEDLENSSDEVAKDSAVIKITYGTDEKNKTVVNSSDDGEEQDKLDGEGFVVVTNRRKSRQKITNGVPELYNQQSICASVR

SEQ ID NO: 15409 - protein, 1533 aa, Cicer arietinum
MVEENYYEEVQAVTHVRRLLDIIACTTRFGKPKRTITGPESKPKKNGKAQNQNKSSVSPPATPNGDSRVGLPSSDPPASPISDNVGMVAIHPTPKLSDFYEFFSFSHLTPPILHLKKCETKDEDDRRKGDYFQLQVKISNGKMIEVVASEKGFYSVGKLSLQSHTLVDLLQQLSRGFSNAYGSLMKAFSDRNKFGNLPYGLRSNTWLVPPSVGESLSNFPALPAEDENWGGNGGGQGRNRAYDLRPWATDFAILASLPSKTEEERVIRDRKAFLLHSQFVDTSIFKAAAAIQHVMESKSSKKNEMNSVLHQDQVGDLLIVVKHDGNGKFDSTLNEPSKQNEHVQKNLIKGLSADESVTVNDTSSLTVVVVNHCGYTATVKVVGNANAKKPKVQDIEIDDQPDGGANALNINSLRVLLHKSGAEFSEGTLTSLSNFDDLDASKDLVRKVVEEWTEKIKEEPSVSERSIRWELGSSWMQHLQKQETSTDVGSDNKNGNVEQAVKGLGNQFKFLKKREKKASELDGTDSREPNNDELSSSNELETLLSKEAFSRIKESGSGLHLKSVDELINMAHKFYDEVALPKLVTDFGSLELSPVDGRTLTDFMHLRGLKMGSLGEVVKLAENLPHIQSLCIHEMITRAFKHLLKAVIASVNNVADLPSVIASTLNFLLGGCRTEDTDQTSGDDHRLKIHWLRSFLSQRFGWTLKDEFQHLRKLSILRGLCHKVGLELFPRDYDMESPKPFGKYDIISLVPVCKHVGCSSIDGRNLLESSKIALDKGKLEDAVSYGTKALAKMMAVCGPYHRNTASAYSLLAVVLYHTGDFNQATIYQQKALDINERELGLDHPDTMKSYGDLSVFYYRLQHIELALKYVNRALFLLHFTCGLSHPNTAATYINVAMMEEGMGNVHVALRYLHEALKCNKRLLGADHIQTAASYHAIAIALSLMEAYSLSVQHEQTTLKILQAKLGAEDLRTQDAAAWLEYFESKAIEQQEAAKNGTPKTDTSIASKGHLSVSDLLDFISPDNDSKGNDAQRKQRRPKILPISDNNGQEHDDAAAIADDGVLVDNVKDVKTTVEGNVNETNATHDSDEPKDIGGDLSRHKPVTSEAVYETSSDEGWQEANSKGRSGNGANRKSGRRQRPNLSKLSIHKETSYRNDTTSLPQKGAPKVTSALLSPSRQSKTSKALLSSKISSSPASLSSLASKSISYKEVAVAPPGTVLKPLLEKTEVEKVNDENETQKQEASIEKSIAEAVQQQDEKEVIHDESEKESSASELEKVSLSSDQTKPTETNGSKLSAAAKPFSPGTLSASRHLNPVPVASIYDANGSQGILVEPVLPPAAARVPCGPRSPLYYRTNYTFRMKHGSSKIREISGSGGPRIMNPHAPEFVPRSASQIETSDANSNVSSDENKSSPSKHSLSESEKSEIARQILLSFLVKSVHQNADAVDEAKITEGEVEDLENSSDEVAKDSAVIKITYGTDEKNKTVVNSSDDGEEQDKLDGEGFVVVTNRRKSRQKITNGVPELYNQQSICASVR

SEQ ID NO: 15410 - protein, 527 aa, Saccharum officinarum
MADGSASASPPSFSPHQYHRDAIKSSVRNTAANRRREQALAIGKERREALMRAKRVCRAPLSGSDEAVAEDGDMVIDEGKADLEARTTQAVEELKSALSSQGKGAQKRKIEVLRALRRLLSQSEVPPVDAAIKAGAVPLLVQYLSFGSSDEQLLEAAWCLTNIAAGEPEETKSLLPALPLLIAHLGEKSSTLVAEQCAWAIGNVAGEGAELRSTLLAQGALWPLARLMMSNKGSTARTAAWALSNLIKGPDSKAANELIGINGVLNAITRNLEKADEELATEVAWVVVYLSALSEKATSLIVRSSVPQLLIGRLLASENLQLLIPVLRGLGNLVAGDGYMVDSVLIVGNSVTDQALSSLIKCLKSDNRVLKKEASWAMSNIAAGSFEHKKLIFASEATPLLMHLLRTAQFDIRREAAYTLGNLCVVPAGSGNPPNIIIEHLVAIVDGGALPGFINLVRSADIESARLGLQFLELVMRGYPNSQGPKLVEAEDGIEAMERFQFHENEVMRTMANGLVDKYFGEDYGLE

SEQ ID NO: 15411 - protein, 527 aa, Setaria italica
MDDGSASASPSSASPHQHHRDAIKSSVHNSASSRRREHAIAVGKERREALMRAKRVCRAPLSGNDETVMEEGDMVIDEKKADLEAQTAQAVEELKSALSTQGKGAQKKKIEVLRALRRLLSQSEVPPVEAAIKAGAIPLLVQYLSFGSSDEQLLEAAWCLTNIAAGEPEETKSLLPALPLLIAHLGEKSSTLVAEQCAWAIGNVAGEGADLRSKLLAQGALWPLARLMLSNKGSTARTAAWALSNLIKGPDPKAANELISIDGVLNAIIRNLEKADEELATEVAWVVVYLSALSEKATSLIVRSSVPQLLIGRLLASENLQLLIPVLRSLGNLVAGDGYMVDSVLTVGNSITDQALSSLIKCLKSDNRVLKKEASWAMSNIAAGSFEHKKLIFASEAMTLLMHLLTTAQFDIRREAAYTLGNMCVVPAGNAAPPNIIVDHLVAIVNGGALPGFINLVRSADIESARLGLQFLELVMRGYPNGQGPKLVESEDGIEAMERFQFHENELMRNMANGLVDKYFGEDYGLE

SEQ ID NO: 15412 - protein, 528 aa, Sorghum bicolor
MADGSASASPPSVSPHHQYHRDAIKSSVRNTAANRRREQALAIGKERREALMRAKRVCRAPLSGSDEAAAEDGDMVTDEGKADLEARTTQAVEELKSALSSQGKGAQKRKTEVLRALRRLLSQSEVPPVDAAIKAGAVPLLVQYLSFGSSDEQLLEAAWCLTNIAAGEPEETKSLLPALPLLIAHLGEKSSTLVAEQCAWAIGNVAGEGAELRSTLLAQGALWPLARLMLSNKGSTARTAAWALSNLIKGPDSKAANELIGIDGVLNAITRNLEKADEELATEVAWVVVYLSALSEKATSQIVRSSVPLLLIGRLLASENLQLLIPVLRGLGNLVAGDGYMVDSVLTVGNSVTDQALASLIKCLKSDNRVLKKEASWAMSNVAAGSFEHKKLIFASEATPLLMHLLRTAQFDIRREAAYTLGNLCVVPAGSGNPPNIIVDHLVAIVDGGGLPGFINLVRSADIESARLGLQFLELVMRGYPNNQGPKLVEREDGIEAMERFQFHENEVMRNMANGLVDKYFGEDYGLE

SEQ ID NO: 15413 - protein, 528 aa, Sorghum bicolor
MADGSASASPPSVSPHHQYHRDAIKSSVRNTAANRRREQALAIGKERREALMRAKRVCRAPLSGSDEAAAEDGDMVIDEGKADLEARTTQAVEELKSALSSQGKGAQKRKTEVLRALRRLLSQSEVPPVDAAIKAGAVPLLVQYLSFGSSDEQLLEAAWCLTNIAAGEPEETKSLLPALPLLIAHLGEKSSTLVAEQCAWAIGNVAGEGAELRSTLLAQGALWPLARLMLSNKGSTARTAAWALSNLIKGPDSKAVNELIGIDGVLNAITRNLEKADEELATEVAWVVVYLSALSEKATSQIVRSSVPLLLIGRLLASENLQLLIPVLRGLGNLVAGDGYMVDSVLTVGNSVTDQALASLIKCLKSDNRVLKKEASWAMSNVAAGSFEHKKLIFASEATPLLMHLLRTAQFDIRREAAYTLGNLCVVPAGSGNPPNIIVDHLVAIVDGGGLPGFINLVRSADIESARLGLQFLELVMRGYPNNQGPKLVEREDGIEAMERFQFHENEVMRNMANGLVDKYFGEDYGLE

SEQ ID NO: 15414 - protein, 524 aa, Triticum aestivum
MADGNAPGSPASSLQSHRYAIKSSVHNTAASRRREQAIAIGKERREALMRAKRVCRAPLSGSDEATIEDGDMVIDEKADLETRTAQAVEELKSALSSQGKGAQKKKIEALRAVRRVLSQSEVPPIQVAIKAGAVPLLVQYMSFGSSDEQLLEAAWCLTNIAAGEPEETKSVLPALPLLVAHLGEKSSTLVAEQCAWAIGNVAGEGADLRSTLIAQGALWPLARLMLSSKGSTARTAAWALSNLIKGPDPKAAYELINIDGVLNAIIRNLEKADEELATEVAWVVVYLSALSEKAISLIVRSHVPQLLIGRLLASENLQLLIPVLRGLGNLVAGDEYMVDSILIVGNSITDQALSSLIKCLKSDNRVLRKEASWALSNIAAGSFEHKKLIFTSEATPSLIHLLTSAQFDIRKEAAYTLGNLCVVPAGSTEPPNIITEHLVSIINGGALPGFINLVRSADIESARLGLQFLELVMRGYPNGQGPQLVERGDGIEAMERFQFHENEAMRNMANGLVDKYFGEDYGLE

SEQ ID NO: 15415 - protein, 526 aa, Zea mays
MADGSASASPPSVSPHQYHRDAIKSSVRNTAANRRREHAIAIGKERREALMRAKRVCRAPLSGSDEAAGEEGDMVVDEEKADLETRTTQAVEELKSALSSQGKGAQNRKTEVLRALRRLLSQSEVPPVDAAIKAGAVPLLVQSLSFGSPDEQLLEAAWCLTNIAAGKPEETKSLLPALPLLIAHLGENSSTLVAEQCAWAIGNVAGEGAELRNTLLAQGALWPLARLMLSNKGSTTRTAAWALSNLIKGPDSKAANELIGIDGILNAIIRNLEKADEELVTEVAWVVVYLSALSEKATSLIVRSSMPQLLIGRLLASENLQLLIPVLRGLGNLVAGDGYMVDSVLIVGNSVTDQALSSLIKCLKSDHRVLKKEASWAMSNIAAGSFEHKKLIFASEATPLLMHLLRTAQFDIRREAAYTLGNLCVVPAGSGNPPTIIVEHLVAIVDGGALPGFINLVRSADIESARLGLQFLELVMRGYPDSQGPKLVETEDGIEAMERFQFHENEMMRNMANGLVDKYFGEDYGL

SEQ ID NO: 15416 - protein, 526 aa, Zea mays
MADGSASASPPSVSPHQYHRDAIKSSVRNTAANRRREHAIAIGKERREALMRAKRVCRAPLSGSDEAAAEEGDMVVDEEKADLETRTTQAVEELKSALSSQGKGAQNRKTEVLRALRRLLSQSEVPPVDAAIKAGAVPLLVQSLSFGSPDEQLLEAAWCLTNIAAGKPEETKSLLPALPLLIAHLGENSSTLVAEQCAWAIGNVAGEGAELRNTLLAQGALWPLARLMLSNKGSTTRTAAWALSNLIKGPDSKAANELIGIDGILNAIIRNLEKADEELATEVAWVVVYLSALSEKATSLIVRSSMPQLLIGRLLASENLQLLIPVLRGLGNLVAGDGYMVDSVLIVGNSVTDQALSSLIKCLKSDHRVLKKEASWAMSNIAAGSFEHKKLIFGSEATPLLMHLLRTAQFDIRREAAYTLGNLCVVPAGSGNPPSIIVEHLVAIVDGGALPGFINLVRSADIESARLGLQFLELVMRGYPDSQGPKLVETEDGIEAMERFQFHENEMMRNMANGLVDKYFGEDYGL

SEQ ID NO: 15417 - protein, 523 aa, Pennisetum glaucum
MADGGASASPSSATPHQHHRDALKSSVHNSASSRRREHAIAVGKERREALMRAKRVCRGDDETLMEEGDMAIDEKKADLEARTAQAVEELKSALSTQGKGAQKKKIEVLRALRRLLSQSEVPPVEAAIKSGAIPLLVQYLAFGSSDEQLLEAAWCLTNIAAGEPEETKSLLPALPLLIAHLGEKSSTLVAEQCAWAIGNVAGEGADLRSKLLAQGALWPLARLMLSNKGSTSRTAAWALSNLIKGPDPKAANELISIDGVLNAIIRNLEKADEELATEVAWVVVYLSALSEKATSLIVRSSVPQLLIGRLLASENLQLLIPVLRSLGNLVAGDGYMVDSVLTVGNSITDQALSSLIKCLKSDNRVLKKEASWAMSNIAAGSLDHKKLIFASEARTWLIYLLTTAQFDIRREAAYTLGNLCVVPAGNAAPPNIIVDHLVAIVNGGALPGFINLVRSADIESARLGLQFLELVMRGYPDGQGPKLVENGDGIEAMERFQFHENELMRNMANGLVDKYFGEDYGLE

SEQ ID NO: 15418 - protein, 524 aa, Hordeum vulgare
MADGNAPGSPASSLQSHRYAIKSSVHNTAASRRREQAIAIGKERREALMRAKRVCRAPLSGNDEATIEDGDMVIDEKADIETRTAQAVEELKSALSSQGKGAQKKKIEALRAVRRVLSQSVVPPIQVAIKAGAVPLLVQYLSFGSSDEQLLEAAWCLTNIAAGEPEETKSVLPALPLLVAHLGEKSSTLVAEQCAWAIGNVAGEGADLRSTLIAQGALWPLARLMLSSKGSTARTAAWALSNLIKGPDPKAAYELINIDGVLNAIIRNLEKADEELATEVAWVVVYLSALSEKAISLIVRSHVPQLLIGRLLASENLQLLIPVLRGLGNLVAGDEYMVNSILIVGNSITDQALSSLIKCLKSDNRVLRKEASWALSNIAAGSFEHKKLIFTSEATPSLIHLLTSAQFDIRKEAAYTLGNLCVVPAGSTEPPNIITEHLVSIINGGALPGFINLVRSADIESARLGLQFLELVMRGYPNGQGPQLVERGDGIEAMERFQFHENEAMRNMANGLVDKYFGEDYGLE

SEQ ID NO: 15419 - protein, 527 aa, Brachypodium distachyon
MADGNTPASPPPASPLQRHRYAIKSSVHNTAASRRREQAIAIGKERREALIRAKRVCRTPLSGSDDAGIEEDDMVVDKEKEGLEARTAQAVEELKSALSSQGKGAQKKKTEVLRALRRLLSQSEVPPIEAAIKAGAVPLLVQYLSFGSSDEQLLEAAWCLTNIAAGEPEETKSLLPALPLLVAHLGEKSSTLVAEQCAWAIGNVAGEGADLRSTLLAQGALWPLARLMLSSKGSAARTAAWALSNLIKGPDPKAVNELIGIEGVLNAIVQNLEKADEELATEVAWVVVYLSALSEKAISLIVRSHVPQLLIRRLLASENLQLLIPVLRGLGNVVAGDGYMVDSILIVGNNITDQALSSLIKCLRSDNRVLRKEASWVLSNIAAGSFEHKKLIFTSEATPVLIHLLNNAQYDIRKEAAYTLGNLCVVPAGSSEPPNIIVEHLVSIINSGALPGFINLLRSADIESARLGLQFLELAMRGYPDGQGPNLVEREDGIEAMERFQFHENDVMRNMANGLVDKYFGEDYGVE

SEQ ID NO: 15420 - protein, 527 aa, Festuca arundinacea
MADGNNPAPPSAASPLQSHRYAIKSSVHNTAASRRREQAVAIGKERREALMRAKRVCRTPLSGSNESAIEDGDMVIDDEKEGLETRTAQAVQELKSSLSSQGKGAQKKKIEALRALRRLLSQSEVPPIEVAIKAGAVPLLVQFLSFGSSDEQLLETAWCLTNIAAGQPEETKTLLPALPLLIAHLGEKSSTLVAEQCAWAIGNVAGEGSDLRSTLLAQGALLPLARLMLSNKGSTARTAAWALSNLIKGPDPKAVNELIKIEGVLNAITRDLEKADEELATEVAWVVVYLSALSEKAISLIVRSHVPQLLIARLLASENLQLLIPVLRGLGNLVAGDGYMVDSVLIVGHSITDQALSSLIKCLKSDNRVLRKEASWALSNIAAGSFEHKKLIFTSEATPLLIHLLTSAQFDIRKEAAYTLGNLCVVSAGSTDPPNIITEHLASIINGGALPGFVNLVRSADIESARLGLQFLELVMRGYPNGQGPALVERQDGIDAMERFQFHENEAMRNMANGLVDKYFGEDYGLE

SEQ ID NO: 15421 - protein, 234 aa, Zea mays
MATRHLLLLLLAALLPAAATADPDAVQDYCVPDTGGGRGRGRAVDLALLPSYPCRSPANLTAADFAFAGVRAAGNFSADTGFAGVSVTPAQFPALHTLGVSFARADLSAAGGVNPPHYHPRATETALVLAGRVYAGFVDSGGRVFAKVLEKGEVMVFPRAMVHFQMNVGDEPATVYGTFNSENPGIVRIPATVFGSGIKDAVLERAFGLEPEELRRLQKRFGPPPKTKTAEMDD

SEQ ID NO: 15422 - protein, 229 aa, Panicum virgatum
MAAHHILLLLAALLPAAATADPDAVQDYCVPDAAGRGRPLELALLPSYPCRSPANLTAADFAFAGVRAAGNFSADTGFAGVSVTPAQFPALHTLGVSFARADLSAAGGVNPPHYHPRATETALVLAGRVYAGFVDSGGRIFAKVLEKGEVMVFPRAMVHFQMNVGDEPATVYGTFNSENPGIVRIPATVFGSGISAGVLERAFGLSPAELRRLEKRFGPPKTKLSEMDD

SEQ ID NO: 15423 - protein, 229 aa, Panicum virgatum
MAAHHLLLLLAALLPAAATADPDAVQDYCVPDAGGRGRPLELALLPSYPCRSPGNLTAADFAFAGVRAAGNFSADTGFAGVSVTPAQFPALHTLGVSFARADLSAAGGVNSPHYHPRATETALVLAGRVYAGFVDSGGRIFAKVLEKGEVMVFPRAMVHFQMNVGDEPATVYGTFNSENPGIVRIPGTVFGSGISAGVLERAFGLSPAELRRLEKRFGPPKTKLSEMDD

SEQ ID NO: 15424 - protein, 230 aa, Setaria italica
MAAHHLLLLLLAVLLPAAATADPDAVQDYCVPDAGGRGRPLELSLLRTYPCRSPVNLTASDFAFAGVRAAGNFSADTGFAGVSVTPAQFPALHTLGVSFARADLSAAGGVNPPHYHPRATETALVLAGRVYAGFVDSGGRIFAKVLEKGEVMVFPMGMVHFQMNVGDEPATVYGTFNSENPGIVRIPATVFGSGIKGGVLERAFGLSPAELRRLEKRFGPPKTKLSEMED

SEQ ID NO: 15425 - protein, 240 aa, Panicum virgatum
MAPRRHLLLRLAAAVVLIPAATTADPDAVQDYCVPDTGGRGRAVELPLLPSYPCRSPANLTASDFAFAGVRAAGNFSSDTGFAGVSVTPAQFPALHTLGVSFARADLSAAGGVNPPHYHPRATETALVLAGRVYAGFVDSGGRLFAKVLARETGGHGLPARHGALPVERRRRARHGLRDLQQREPRHRAHPGHRLRLRDQGRRPREGVWPLTGGAPPAGEEVQPAQEDQDGGGDGRLAIS

SEQ ID NO: 15426 - protein, 228 aa, Triticum aestivum
MALHHLGLLLLAVLLPAAAIGADPDAVQDFCVPDPGRGRPVELNLIRSYPCRSPANLTAGDFAFSGVRAAGNFSADTGFAGVSVTPAQFPGLHTLGMSFARADLSAAGGVNPPHYHPRATETALVLAGRVYAGFVDTGGRLFAKVLVEGEVMVFPRGMVHFQLNVGDQPATVYGTFNSENPGIVRIPATVFGSGIRDAVLERAFGLSPEELRRIEKRFGVPKKAELED

SEQ ID NO: 15427 - protein, 229 aa, Oryza sativa
MAHRRRCLLLLLAVLLPAMAARGDPDAVQDFCVPDAGRGRPVELAMLPAYPCRSPANLTAGDFAFSGVRAAGNFSPETGFAGVSVTPAQFPGLHTLGMSFARADLSAAGGVNPPHYHPRATETALVLAGRVYAGFVDSGGRLFAKVLEQGEVMVFPRAMVHFQLNVGDTPATVYGAFNSENPGIVRIPATVFGSGIREAVLERAFGLTPAELRRLEKRFGPPKKAEMED

SEQ ID NO: 15428 - protein, 200 aa, Saccharum officinarum
MAPRDLLLLLLAAVLLPASSTADPDAVQDYCVPDTGGRAVPVDPARLPSYPCRSPTNLTAADFASAGVRAAGNFSADTGFAGVSVTPAQFPALHTLGMSFARADLSAAGGVNPPHYHPRATETALVLSGRVYAGFVDSGGRLFAKVLEKGEVMVFPRAMVHFQMNVGDEPATVYGSFNSENPGIVRIPATVSGPGSWTGL

SEQ ID NO: 15429 - protein, 638 aa, Saccharum officinarum
MSAAIGGAELHGFRGAAAQLPRSRMLGRPIRVAPPAAATPGGGGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMSAEEPPEVTKARNDNSHGTNFPDSPEPIYGIQYLPRKFKIAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVAGQAKKTLREIIEKYNLDVSITPNQNLILCGIDQAWREPITTALAQAGLLEPQDVDPLNLTSMACPALPLCPLAQTEAERGILPILKRIRTVFNKVGIKDSESVVVRITGCPNGCARPYMAELGFVGDGPKSYQIWLGGTPNQSTLAESFMDKVKLDDIEKVLEPLFSYWNSTRQEGESFGSFTNRTGFDKLKEVVNKWAESPSAA

SEQ ID NO: 15430 - protein, 637 aa, Sorghum bicolor
MSAAIRGAEFPGFRGAAAQLPRSRMLGRPIRVAPPAAAQPGGGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIATLLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPQDVDPLNLTSMACPALPLCPLAQTEAERGILPILKRIRTVFNKVGIKDSESVVVRITGCPNGCARPYMAELGFVGDGPKSYQIWLGGTPNQSTLAESFMDKVKLDDIEKVLEPLFSYWNSTRQEGESFGSFTNRTGFDKLKDVVNKWAESPSAA

SEQ ID NO: 15431 - protein, 635 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPFVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 15432 - protein, 582 aa, Pennisetum glaucum
PLKKDAAEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVRKDILFAQQTAENIAALLTPQSGAYYDLWVDGEKIMSAEEPPEVTKARNDNSHGTNFPDSPEPIYGTQYLPRKFKIAVTTAGDNSVDILTNDIGVVVVSDDAGEPVGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTSMACPALPLCPLAQAEAERGILPILKRIRAVLNKVGIKDSESVVVRITGCPNGCARPYMAELGFVGDGPKSYQIWLGGTPNQSTLAESFMNKVKLDDIEKVLEPLFSYWNSTRQEGESFGSFTNRTGFDKLKEVVDKWVESPSAA

SEQ ID NO: 15433 - protein, 1839 aa, Glycine max
MAPRNSRGKAKGEKKKKEEKVLPVVIDITVKLLDETHVLKGISTDRIIDVRRLLSVNTETCYITNFSLSHEVRGPRLKDTVDVSALKPCILDLVEEDYDEDRAVAHVRRLLDIVACTTSFGPPSPKNDSGTVQKSGKSEAPPSKQSAKDAAAADLDGEISHSCPKLENFYEFFSLSHLTAPIQYVKRGSRRHVEEISEEDYLFSLDVKVCNGKVVHVEACRKGFYSVGKQRILCHNLVDLLRQLSRAFDNAFDDLLKAFSERNKFGNLPYGFRANTWLVPPVAAQSPSSFPPLPVEDETWGGNGGGLGRDGKYDLVPWANEFSFIASMPCNTAEERQVRDRKAFLLHSLFVDVAIFRAIKAIKYVMEEPKFSCSIVENNIIYTERVGDLNINVLKDVSVASYKIDTKIDRVEATGVNQKDLLERNILKGITADENTAAHDITTLGVINVRYCGYVVTVKVERGVNENVDSPSQQNIELFDQPEGGANALNINSLRLLLHNTTPPENNKPMSQIQTFESEEFGASHAFLEKLIKESLAKLEEEEPGIDYFVRWELGACWIQHLQDQNNTEKDKKLSLEKAKNEMKVEGLGKPLKALKNYKKKSDSSNTNSATEYSKFNREAESPPFPSIESQLETTEAENELVLKRILSEEAFTRLKESGTGLHCKSMHDLINLSRKYYTDVALPKLVADFGSLELSPVDGRTLTDFMHTRGLRMRSLGHVVKLSEKLSHVQSLCIHEMIVRAFKHILRAVISAVDKEKMASSIAGALNLLLGVPENRELDKSREVHPLVWKWLELFLKKRFDWDPNKLNYKDVRKFAILRGLCHKVGIELVPRDFDMDSPIPFQKSDIVSLVPVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRAKLGPDDLRTQDAAAWLEYFESKAFEQQEAARNGTRKPDASIASKGHLSVSDLLDYINPNTKGRDAAAKRRSQITKVRATSYPNVGMSSSDESSKEIPKEASDEEVQIPILVGSADSEQENNSGPDLEQAILKQISDEKPQIYDEILSEAHAEGEDGWQPVQRPRSAGSYGRRLKQRRATLGKVYSYQKNVEVGSESPFVRSPNPSSRYYFLKKRTISHGSYTDDHTVNITQGTKFGRKVVKAVTYRVKSVPSTSKPCVNEKLENGDKLLSSLPEPDPTDANPVKKSIVSLGKSPSYKEVALAPPGTISKFQVYNPQSVISVSSEHDGGKHEEEDIEADRNVNVDPTPTEVNDMVKEKNDDSLSDSVDDSQDDTGVAIEGKEETQLIVAVQDNCMSAEGQSGDVEAQGAVDNSILIHAVDDHVDSSKQELDASNSSASLEPSDNTNPTSQGGEDLKVNVSPSSQSHTGGIPYKKLSASAAPFNPSPAIARAAPIAMNMTLPSGPSAVPAIGPWPVNMNVHPGPTTVLPTVAPMCSSPHHAYPSPPATPNMMQPLPFVYPPFTQPQSVAPSNYPVTSSAFHANHFTYLNPTISKFGPSAVWPGCHPVEFPLPVPIVEPIRDPISESQVLCHGSESPSSASVLPEDIDSIGDSNQGVKTLSSEISEDEAVRAGSENIKENGNMNFHGSENAGNKQNQNFGSNGSSSSSETNMDGEKTFSILIRGRRNRKQTLRMPISLLTRPNGSQSFKVIYNRVVRGSHATKSMNLSSSKDCTATA

SEQ ID NO: 15434 - protein, 1827 aa, Medicago truncatula
MAPRYSRGKAKGEKKKKEEKVLPVVMDITVNLPDETSVVLKGISTDRIIDVRRLLSVNTETCYITNFSLSHEIRGVRLKDTVDVSALKPCLLTLVEEDYDSDGAVAHVRRLLDIVACTTSFGPSSPPKNAAKSTKSQPPPAKQLQKEAAAAADADGDISHSCPKLESFYEFFSLSHLTAPLQYVKKASKRNVEEILEEDHLFSLDVKVCNGKVVHVEACRKGFYSVGKQRILCHNLVDLLRQISRAFDNAYDDLLKAFSERNKFGNLPYGFRSNTWLVPPIAAQSPSFFPPLPVEDENWGGNGGGLGRDGEYDLIPWANKFSFIASMPCKTAEERQGRDRKAFLLHSLFVDVAIFRAIRAVKHVLEDPSFNCSAVENDIYSERVGDLSVRVLKDGSVASCKIDSKIDGVEATGVNQKDLVERNLLKGITADENTAAHDITTLGVVYVRYCGYVVVVKVEGGANDNANSSFHQNNEVFDQPEGGANALNINSLRFRLHSTALPENNKQMNEIQMFESEELGGTDAFVEKLIKKSLAKLEEEELSSDYFVRWELGACWVQHLQDQNSTEKDKKPSLEKANNEMKVEGLGKPLKALKNNKKKSDSTNTNCASEHSKSNLEGENDALSSSESQHETAAVDNELVLKRMLSEAAFTRLKESGTGLHCKSMQDLIDLSQKYYMDVAIPKLVADFGSLELSPVDGRTLTDFMHTRGLRMRSLGHVVKLSEKLSHVQSLCIHEMIVRAFKHILRAVISSVVDKENMASSIAGALNLLLGVPENKESDKSCDVHPLVWKWLELFLKKRFDWDLSRLNYKDVRKFAILRGLCHKVGIELVPRDFDMDSPFPFQKSDIVSLVAVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHIALRYLHKALKCNQKLLGADHIQTAASYHAIAIALSLMEAYPLSVQHEQTTLQILRAKLGPDDLRTQDAAAWLEYFESKAFEQQEAARNGTRKPDASIASKGHLSVSDLLDYINPNHDAKGRDAAAKRRNQVRAISYQNNVSVSSDESSKEIQKEASDEELHIPEPASSADSENESNSAPDPEQPILEKILDEKPQPSNELLSEAHPDGDDGWQSVQRPRSAGSYGRRLKQRRATHGKVYSYQKNVEVGTEHSSVKSANQNSKYYFLKKRTIHHGGADNRAVNISQGAKFGRKAVKAVAYRVKSTPSASKTVANETLEIVGDKEVDSIEVNPVKTSIVSLGKSPSYKEVALAPPGTISKLQVYNPQNEISVSQEHDVGKHEEEDIEAHRNIDPTPKEANNVFKEKSDDSLSDSIEDSQDDTVVSTEKKEETQLNKVVQDSCATAEGLESGDVEAQGAVDNSIVIDAVEDAMESYKQELVASDLPCSFEPSDNTSSSPHGGEDLGVNLLSPSQSQAGGISYKKLSASAAPFNPSPAIARVAPIAMNMSHPSGPGPVPAIGPWPVNMNVHPGPATVLPAGNPMCSSPHHAYPSPPTTPNMLQPLPFMYPPYTQPQSVQTSSGFHANHFTWQCNLNPVISKFGPGAVWTGCHPVEYPRPVPIVEPIPDIILEPQVQFHAVESPSPASVLPDDIDKVGDLNKEVKTSASEMSEDETVRVGSESIKENGNPNFPGTDNAGNDPNQIVGSNISTSSSEMNMDDEKTFSILIRGRRNRKQTLRMPISLLTRPHGSQSFKVIYNRVVRGNDSPRSMNFSSSKHCTATA

SEQ ID NO: 15435 - protein, 356 aa, Sorghum bicolor
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVGVATVTDLQLNTVGSVLSLLAIITTCIAQIMTNTIQKKFKVSSTQLLYQSCPYQALTLFLIGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQAKEGESNPLISDSLSAAENGGSATDDEPLKVPMWSSKYSKA

SEQ ID NO: 15436 - protein, 356 aa, Setaria italica
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNTVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQGKESESNPLISDSLNAAENGGSTPDDEPLKVPMWSSKYSRA

SEQ ID NO: 15437 - protein, 356 aa, Oryza sativa
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 15438 - protein, 356 aa, Brachypodium distachyon
MGVGGEKFQLGTVGALSLSVVSSVSIVICNKALMSSLGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSILSLLAIVTTCIAQIMTNTIQKKFKVSSTQLLYQSCPYQALTLFVTGPFLDGFLTNKNVFAFEYTPQVLFFIVLSCLISVSVNFSTFLVIGKTSPVTYQVLGHLKTCLVLAFGYVLLHDPFSWRNILGILIAVIGMGLYSYFCTRETQQKPTDASPQVTQVKEGESDPLISDSLNSAENGGAAADDEPLKVPMWSSKYSRA

SEQ ID NO: 15439 - protein, 354 aa, Festuca arundinacea
MGVAGEKFQLGTVGALSLSVVSSVSIVICNKALMSALGFIFATTLTSWHLLVTFCSLHVALCLKFFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFVVGPFLDGFLTNKNVFAFDYTPQVLFFIVLSCLISVSVNFSTFLVIGKTSPVTYQVLGHLKTCLVLAFGYVLLHDPFSWRNILGILIAVIGMGLYSYFCTRETKPTEASPQVTQVKEGESDPLISDSLSSAENGAAAADDEPLKVPMWSSKYARA

SEQ ID NO: 15440 - protein, 354 aa, Lolium multiflorum
MGVGGEKFQLGTVGALSLSVVSSVSIVICNKALMSALGFIFATTLTSWHLLVTFCSLHVALCLKFFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFVVGPFLDGFLTNKNVFAFDYTPQVLFFIVLSCLISVSVNFSTFLVIGKTSPVTYQVLGHLKTCLVLAFGYVLLHDPFSWRNILGILIAVIGMGLYSYFCTRETKPTEASPQVTQVKEGESDPLISDSLSSAENGAAAADDEPLKVPMWSSKYARA

SEQ ID NO: 15441 - protein, 354 aa, Oryza sativa
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSLLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLTFGYVLLHDPFSWRNILGILIAVVGMVLYSYFCTLEGQQKNAEVSPQQAKEGDSAPLISDSLSKVENGGGVVDDEPLKVPMWSSKYSRA

SEQ ID NO: 15442 - protein, 354 aa, Sorghum bicolor
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKAENGGGGVDDEPLKVPMWSSKYSRE

SEQ ID NO: 15443 - protein, 354 aa, Setaria italica
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSTLSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKVENGGGVADDEPLKVPMWSSKYSRE

SEQ ID NO: 15444 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSRE

SEQ ID NO: 15445 - protein, 352 aa, Brachypodium distachyon
MGVGGEKFQLGTVGALSLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETLFFRKKFSRTIQISLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCSVEAQPKSAEVSTQQAKESDSAPLISDSLSKVENGGDDDEPLKVPMWSSKYSRA

SEQ ID NO: 15446 - protein, 118 aa, Cenchrus ciliaris
VVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFRFVTCHVLYAAR

SEQ ID NO: 15447 - protein, 353 aa, Theobroma cacao
MSENRKFQLGTVGALSLSVVSSVSIVICNKALISTLGFTFATTLTSWHLLVTFCSLHVALWMKLFEHKPFDARAVMGFGILNGISIGLLNLSLGFNSVGFYQMTKLAIIPCTVLLETLFFRKRFSRNIQLSLAILLLGVGIATVTDLQLNLLGSVLSLLAVITTCVAQIMTNTIQKKFKVSSTQLLYQSCPYQAITLFIIGPFLDGLLTNQNVFAFKYTPQVLFFIVLSCLISVSVNFSTFLVIGKTSPVTYQVLGHLKTCLVLAFGYVLLRDPFSWRNILGILIAVLGMVLYSYYCTSETQQQKASEASAQLPQVKESESDPLISVENGSGILSDGVGPKAPVWSSNKDLHA

SEQ ID NO: 15448 - protein, 352 aa, Vitis vinifera
MGESQRFQLGTVGALSLSVVSSVSIVICNKALISSLGFSFATTLTSWHLLVTFCSLHVALWMKLFEHKPFDARAVMGFGILNGTSIGLLNLSLGFNSVGFYQMTKLAIIPCTVLLETLFFRKRFSRSIQLSLSILLLGVGIATVTDLQLNALGSVLSLLAVITTCIAQIMTNNIQKKFKVSSTQLLYQSCPYQAMTLFIAGPFLDWLLTKQNVFAFKYTSEVLVFIVLSCLISVSVNFSTFLVIGKTSPVTYQVLGHLKTCLILAFGYVLLHDPFSWRNILGILIALIGMVLYSYYCSREGQQKPSEVSAQMAQAKESETDPLIGVENGAGILTDAVVAKVPAWNSNKDLQA

SEQ ID NO: 15449 - protein, 344 aa, Panax ginseng
MGDSQLGTIGALSLSVVSSVSIVICNKALISTLGFTFATTLTSWHLLVTFCSLHVALWMKLFEHKPFDPRAVMGFGILNGTSIGLLNLSLGFNSVGFYQMTKLAIIPCTVLLETLFFRKKFSRNVQLSLTVLLLGVGIATVTDLQLNVVGSVLSLLAVITTCVAQIMTNTIQKKFKVSSTQLLYQSCPYQAITLFLVGPFVDGFLTNKNVFAFNYTPYVLAFIVLSCLISVSVNFSTFLVIGKTSPVTYQVLGHLKTCLVLAFGYILLRDPFSWRNILGILVAVVGMVLYSYYCTRETQQQKASEASAQLSQAKESESDPLINVENGGDIQKAPAWNSNKDLHA

SEQ ID NO: 15450 - protein, 353 aa, Vitis vinifera
MSENKGFELGTIGALSLSVVSSVSIVICNKALISSLGFTFATTLTSWHLLVTFCSLHVALWMKLFEHKPFDAKAVMGFGILNGISIGLLNLSLGFNSVGFYQMTKLAIIPCTVLLETLFFRKKFSRSIQLALSILLMGVGIATVTDLQLNALGSILSVLAVITTCIAQIMTNTIQKKFKVSSTQLLYQSCPYQALTLFISGPFLDWFLTSQNVFAFKYTPQVLVFIVLSCLISVSVNFSTFLVIGKTSPVTYQVLGHLKTCLVLAFGYVLLHDPFSWRNILGILIALVGMVLYSYYCTREGQQKTSEASAQSSSQAKEGEADPLINIENETGILTDAAVPKAPVWSSNKDLHA

SEQ ID NO: 15451 - protein, 344 aa, Panax ginseng
MGDSQLGTIGALSLSVVSSVSIVICNKALISTLGFTFATTLTSWHLLVTFCSLHVALWMKLFEHKPFDPRAVMGFGILNGTSIGLLNLSLGFNSVGFYQVTKLAIIPCTVLLETLFFRKKFSRNVQLSLTVLLLGVGIATVTDLQLNVVGSVLSLLAVVTTCVAQIMTNTIQKKFKVSSTQLLYQSCPYQAITLFLVGPFVDGFLTNKNVFAFNYTPYVLAFIVLSCLISVSVNFSTFLVIGKTSPVTYQVLGHLKTCLVLAFGYILLRDPFSWRNILGILVAVVGMVLYSYYCTRETQQQKASEASAQLSQAKESESDPLINVENGGDIQKAPAWNSNKDLHA

SEQ ID NO: 15452 - protein, 344 aa, Panax ginseng
MGDSQLGTIGALSLSVVSSVSIVICNKALISTLGFTFATTLTSWHLLVTFCSLHVALWMKLFEHNPFDPRAVMGFGILNGTSIGLLNLSLGFNSVGFYQMTKLAIIPCTVLLETLFFRKKFSRNVQLSLTVLLLGVGIATVTDLQLNVVGSVLSLLAVVTTCVAQIMTNTIQKKFKVSSTQLLYQSCPYQAITLFLVGPFVDGFLTNKNVFAFNYTPYVLAFIVLSCLISVSVNFSTFLVIGKTSPVTYQVLGHLKTCLVLAFGYILLRDPFSWRNILGILVAVVGMVLYSYYCTRETQQQKASEASAQLSQAKESESDPLINVENGGDIQKAPAWNSNKDLHA

SEQ ID NO: 15453 - protein, 353 aa, Gossypium raimondii
MSENREFQLGTIGALSLSVVSSVSIVICNKALISTLGFTFATTLTSWHLLVTFCSLHVALWMKLFEHKPFDARAVMGFGILNGISIGLLNLSLGFNSVGFYQMTKLAIIPCTVLLETLFFRKKFSRNIQLSLAILLLGVGIATVTDLQLNILGSILSLLAVVTTCIAQIMTNTIQKKFKVSSTQLLYQSCPYQALTLFIIGPFLDGLLTNKNVFAFKYTPQVLFFIVLSCLISVSVNFSTFLVIGKTSPVTYQVLGHLKTCLVLAFGYVLLHDPFSWRNILGILIAVVGMVIYSYYCTVESQQQKASEVSPQLPQVKESESDPLISVDNGSGMLSDGVGPKAPVWNTNKDLHA

SEQ ID NO: 15454 - protein, 258 aa, Panax ginseng
MGDSQLGTIGALSLSVVSSVSIVICNKALISTLGFTFATTLTSWHLLVTFCSLHVALWMKLFEHKPFDPRAVMGFGILNGTSIGLLNLSLGFNSVGFYQVTKLAIIPCTVLLETLFFRKKFSRNVQLSLTVLLLGVGIATVTDLQLNVVGSVLSLLAVVTTCVAQIMTNTIQKKFKVSSTQLLYQSCPYQAITLFLVGPFVDGFLTNKNVFAFNYTPYVLAFIVLSCLISVSVNFSTFLVIGKTSPVTYQVLGHLKHA

SEQ ID NO: 15455 - protein, 358 aa, Brassica rapa
MEAEGETQWSSLLVPSVLEIAKENTVPPRYLRSEQDKTETLADSCLSSKLPVIDMQRLCSVSAMDTELEKLDLACQDWGFFQLVNHGIDSSFLEKLETEAKDLFNLPMEEKMKLWQRSGEFEGFGQVNIVSEDQKLDWGDMFILTTEPIRSRKPHLFSKLPPSFRETVETYSSQVKSLAKTLFEKMACVLEVKREEMEDLFGDVWQSIKINYYPPCPQPDRVIGLTPHSDAAGLTILLQVNQVEGLQIKKDNKWVVVKPLQDALVVNVGEILEIITNGRYKSIEHRVMVNAEKERLSVAMFHSPGKETVIGPAKSLVDKHKQERLFKSMSTQEFFDAFFARKLNGKSHLDLMTLDPSS

SEQ ID NO: 15456 - protein, 401 aa, Brassica napus
SSVVSLSLTTPLKANSFRKYNLTPLPSLRRISCCSTREISLKSRLALPATCKQRRSVELFTRCGVSSNDFPAEKEKEKEKEKERSFGEWVEFLGEAVSTAFPVWVSLGCLLGLVKPSAFNWVTPDLTIIGLTVTMLGMGMTLTLDDLRGALKMPKELFAGFLLQYSVMPLSAYLVSKLLNLPSHYAAGLILVGCCPGGTASNIVTYIARGNVALSVLMTAASTLSAVIMTPLLTAKLAKQYVAVDALGLVKSTLQVVLLPVLAGAFMNQYFQRVVKFVTPLMAPIAVGTVAILCGTAIGQNASAILASGKQVVMACVLLHASGFLFGYLFSRLLRIDVASSRTVSIEVGMQNSVLGLVLAAEHFGNPLTAVPCAVSSVCHSIIGSVLAGVWRRSSPKQLED

SEQ ID NO: 15457 - protein, 417 aa, Raphanus sativus
  misc_feature (158)..(158): Xaa can be any naturally occurring amino acid
  misc_feature (178)..(178): Xaa can be any naturally occurring amino acid
GLRLENRRRRKMASSVVSLSLSNGTTTPQLKANSFRKFNLTPVHLRRISCSTSREISLESRRRVVAPLPILHRRRRSVELFTRCGVSSSDFPAEKERRRRSFGEWVEYLGEAVSTAFPVWVSLGCLLGLVKPGAFNWVTPDLTIIGLTITMLGMGMTXTLDDLRGALKMPKELFAGFXLQYSVMPLSAFLVSKLLNLPSHYAAGLILVGCCPGGTASNIVTYIARGNVALSVLMTAASTLSAVIMTPLLTAKLAKQYVAVDALGLVKSTLQVVLLPVLAGAFMNQYFQRVVKFVSPLMAPIAVGTVAILCGTAIGQNASAILTSGKQVVMACVLLHLSGFLFGYLFSRLLRIDVASSRTVSIEVGMQNSVLGLVLAAEHFGNPLTAVPCAVSSVCHSIIGSVLAGVWRRSAPKQLED

SEQ ID NO: 15458 - protein, 335 aa, Brassica napus
MASSVISLALTTPLKANSFRKYNLTRLPSLRRISCCSTREFTLKSRLALPATCKQRRSVELLTRCGVSSNDFPAEKEKKRSFGEWVEFLGEAVSTAFPVWVSLGCLLGLVKPSAFNWVTPDLTIIGLTITMLGMGMTLTLDDLRGALKMPKELFAGFVLQYSVMPLSAFLVSKLLNLPSHYAAGLILVGCCPGGTASNIVTYIARGNVALSVLMTAASTLSAVVVLLPVLAGAFMNQYFQRVVKFVTPLMAPIAVGTVAILCGTAIGQNASAILASGKQVVMACVLLHLSGFLFGYLFSRLLRIDVASSRTVSIELACRTRCLDLFWRQSILGIR

SEQ ID NO: 15459 - protein, 1651 aa, Glycine max
MVLTTEGATNSVEAVAFSFLTDDEIRRSSRVKITSPILVDFLLHPVPDGLYDAALGPFDDKSLCKSCGQTSKHCPGHFGHIELVSPVYNPLMFNILSNILQRTCFTCHHFRAPSKEVDIRTSQLELIMKGDIIRAKRLESIIPGKSVDSFNPDESIHPGDGDESQCYSAEQLGENWTSLQFSEAMSVLRKLLTKKHKKCQKCGAKNPKISKPTFGWFHMNVLSADETRADTIRSVESETTNDDISLGGGDTTDVEDITSAGTAKRDKRKKEKLSYKLAEQNKLSGSLLPSQVKGILELLWENEARLCSYINDIQDQGFGKKAGHSMFFLENIFVPPIKFRPPTKGGDNVMEHPQTVLLTKVLQCNISLGDAHLNKSDPSKVLSRWMDLQQSVNMLFDNKTASGKRDVATGICQLLEKKEGIFRQKMMGKRVNFACRSVISPDPYLAVNEIGIPPYFALRLSYPERVTPWNVVKLRNAILNGPESHPGATHYADKVSIVKLPPKGKLLSLTSRKLPTSRGVILHQGKISDHEFEGKVVYRHLKDGDVVLVNRQPTLHKPSIMAHIVRVLKGEKTVRMHYANCSTYNADFDGDEINVHFPQDEISRAEAYNIVNANNQYVKPTSGDPIRALIQDHIVSAALLTKKDTFLSYEEFNQLLYSSGVSMAGLGSFYGKHGQKVFISNSESEMFLFPPAIWKPEPLWTGKQVISALLYYITRGSPPFTAEKNAKIPSNFFKTQIRKGKRYTEDTSKKKDKPDEDKLLIYKNDLVRGVVDKAQFGDYGMIHTVQELYGSNVAGNLLSALSRLFTTFLQMHGFTCGVDDLMLTEGKDVERMNQLKSCEIIGDSVHREFIGVKNSDNIDPVTLQLNIEKKIRSNGEAALTLDRKMTSNLNSRTSSGILKKLLSEGILKPSGKNCISLMTTSGAKGSMVNFQQISSHLGQQELEGKRVPRMVSGKTLPCFPPWDCSPRAGGFIIDRFLTALHPQEYYFHCMAGREGLVDTAVKTSRSGYLQRCLMKNLECLKVCYDHTVRDADGSIIQFHYGEDGVDVHQTSFITEFGALSTNKELVFSNYCRQLDRSSPYINKLPEALEGKAEKFSKQRNLGSMEQADFLRLMEHKYVSCLAQPGEPVGVLASQSVGEPATQMTLNTFHLAGRGEMNVTLGIPRLQEILMAAARDIKTPFMTCPLRHDKSMKDAICLADKLKKITVADIIKSMKVSVVPVTVLGGQVCSIYKLVMKLYKSKQYPEYTDITLDDWEETLRVNFVRELEDAIQNHMTLLSKISGIKKFKTDPQSNYSNSSEDAHSNGSESEKKGQNNDDDDEDGGGVEDTEGYEDLGSDAQKRKLQGTDEVDYEDGPEEETHDGELSEEIEGDEDGSDVDANENYNNVTDANNSEGLEKPSKSKTIDEKQNLKREKKKSEPTTKKYDRAIFVEAKGKHFEIHFRFTGEPHILLTQIAQRTAKKVCIQNFGKVGECKAITCKESGVIYYGKDGRKRIEISASEKEQIPALQTSGVHFKTFWELEDDLDVRYIYSNNVHAMLNAYGVEAARETIIREVQNVFKSYGISVNIRHLTLIADFMTHTGSYRPMNRTGSIADSTSPFIKMCFETAGNFIVEAAYHGQVDNLETPSARICLGLPVKMGTGCHDLIQKLEI

SEQ ID NO: 15460 - protein, 296 aa, Cajanus cajan
MAWNHLRNLNRISIHRILHHRFQPLVNARFFSDAAASLPQPQPKQPSPPSSLKDNELAKFAAISDTWWDSEGPFKPLHAMNPTRLAFIRSALCRHFKKDPYSAKPLEGLKIVDVGCGGGILSEPLARLGATVTGVDAVEKNIKIAQLHAGLDPETSTIEFCCTTAEKLVEEGRKFDAVMALEVIEHVADPAEFCKSLAALTIADGATVISTINRSMRAYATAIVAAEYILHWLPRGTHQWSSFLTPEELVLILQRAGINVEEMAGFVYNPVTGRWSLSDDISVNFIAFGTKSSNNE

SEQ ID NO: 15461 - protein, 190 aa, Trigonella foenum-graecum
MKLLNHLRNLNAIKIHHRILHNRFHPLFFNNPKFFSDSSLPQPQQPTTPHVQQPSPHSSLNRNELAKFAAIAETWWDSEGPFKPLHVMNPTRLAFIRTALCRHFKKDPYSAKPLEGLKIVDVGCGGGILSEPLARMGATVTGVDAVEKNINIARLHAESDPTTSTIEFCCTTAEKLVEEGEKLMQSWPWR

SEQ ID NO: 15462 - protein, 303 aa, Medicago truncatula
MKLMNHLRNLNNGITIHHHILRNRFHPLFFNYPKFFSDSSLPQQPTTPHVQQPPPPSSLNRNELAKFAAIAETWWDSEGPFKPLHVMNPTRLAFVRSALCRHFKKDPYSAKPLEGLKIVDVGCGGGILSEPLARMGATVTGVDAVEKNINIARLHAESDPTTSTIEFCCTTAEKLVEEGRKFDAVMALEVIEHVAEPAEFCKSLAALTIPDGATIISTINRSMRAYATAIVAAEYILRWLPTGTHEWSKFLTPEELVLILQRAGINVEEMAGFAYNPVTGRWSLSDDISVNFIAMGTKANNTE

SEQ ID NO: 15463 - protein, 388 aa, Glycine max
MASLPSFAPFVFLLLVIGSNARTLYPLPSKGGNGSRKPLQTFRPYNIAHRGSNGELPEETRPAYLRAIEEGADFIETDVLSSKDGVLICFHDVTLDDTTDIANHTGFANRKRTYEVQGINMTGFFPVDFTLKELKSLRVKQRYSFRDQQFNGKFQIITFEEFITIAQDAPRVVGIYPEIKNPVFINQQVKWSHGKRFEDKFVETLQKYGYKGSYLSKDWLRQPVFIQSFAPTSLVYISNKTDLPKIFLIDDVIVPTQDTNQSFWEITSDEYLDYIKQYVVGIGPWKDTVVPVVENYMTNPTNLVARAHAHNLQVHPYTYRNEFPFLHFNFSQDPYMEYDYWINKIGVDGLFTDFTGSLHRYQEWTSNHKDDDDKNLLHKIALLVSSYE

SEQ ID NO: 15464 - protein, 387 aa, Trigonella foenum-graecum
MPSLSVFVFLLLVIGGTARPLYPLPGKGGDGSRQPLQTFRPYNVAHRGSNGELPEETREAYLRAIEEGADFIETDILSSKDGVLICFHDVILDDTTDIAKYKEFANRKRTYDVQGVNTTGFFVVDFTLKELKSLRVNQRYSFRDQQFNGKFQIITFEEFITIALEAPRVVGIYPEIKNPVLINQHVKWSDGKRFEDRFVETLQKYGYKGSYLSKHWLKQPAFIQSFAPTSLVYISKQTDLPKIFLIDDVDIPTQDTNQSYWEITSDTYLDYIKQYVVGIGPWKDTIVPVVKNYVTTPSDLVARAHAHNLQVHPYTYRNENQFLHFNFSQDPYKEYDYWINKMGIDGLFTDFTGSLHNFQEWTTPNRQEDKTASKLLHKIALLASAYE

SEQ ID NO: 15465 - protein, 377 aa, Vigna unguiculata
MQVVSSARRVSRFFLSPHLRTSEAPHSSALSPFSGLVQHDYRRVTTDPIHCFLSKAFFSSGVDTVEGAPSGDVKELYDKMLDSVKVKRSMPPNAWLWSMIANCKHQHDIRLLFDILQNLRIFRLSNLRIHDNFNCNLCREVTKACVLAGALDFGKKALWKHNVYGLTPNIASAHSLLLYAKDHNDTKLLVEVMKLVKKNDLPLQPGTADIVFSICYNTDDWVLISKYAQRFVKAGVKLRQTSFETWMQFAAKRGDTKSLWTIEKLRSETMKQHTLATGFSCAKGLLLERKPSDAVAVIQVLNQTLSDKKKSGIKDELQKLVSEWPLEVIKHQKDEDRKALAASLKSDIPIMVSELLSMGLEANVSLEDLDRKEGIPQ

SEQ ID NO: 15466 - protein, 372 aa, Cajanus cajan
MQVVSNARRVSRLFLSPHLRNSEALSLFSGFTQRDCRRVSTDPIHCFLSKAFYSTGVDTVQGAPTEDVKELYDKMIDSVKVKRSMPPNAWLWSMIANCKHHHDISLLFDILQNLRRFRLSNLRIHDNFNCNLCREVAKACVHAGALDFGKKALWKHNVFGLTPNIASAHHLLLYAKDHNDTKLLVDVMKLIRRNDLPLQPGTADIVFSICYNTDDWELINKYAKRFVKAGVKLRQTSFETWMNFAAKRGDTESLWKIEKLRSDSMKPHTLATGFSCAKGHLLERNPSGAVAVIQVLNQTLSDAKKSGIKGELQKLVSEWPLEVIKHQKEEDRKALAASLKSDILAMVSELLSLGLEANVSLEDLDKKEGVPQ

SEQ ID NO: 15467 - protein, 376 aa, Glycine max
MQVFSNARRASWLLLFPHLRTSEAPHSTALSLFSGLAQRDSRQVNTDPVHCLSKAFFSSGMDTVEATPSEDVKELYDKMLDSVKVKRSMPPNAWLWSMIANCKQQHDIRLLFDILQNLRRFRLSNLRIHDNFNCNLCREVAKACVHAGALDFGMKALWKHNVYGLTPNIASVHHLLTYAKNHNDTKLLVEVMKLLKKNDLPLQPGTADIIFSICYNTDDWELINKYAKRFVMAGVKLRQTSFETWMEFAAKRGHTESLWKIEKLRSESMKQHTLITGFSCVKGLLLERKPSDAVAVIQVLNQTLSDTKKSGIKGELQKLVSEWPLEVIKHQKEEDRKALSASLKSDILVMVSELLSVGLDANVSLEDLDRKECIPR

SEQ ID NO: 15468 - protein, 201 aa, Cajanus cajan
MSSYLGVGISPGTVPVNHSTNVKVFDRRIRITELVLRCVILGLGVLAAVLVGTDSQVKEFFSIQKKAKFTDMKALVFLVAANGLAAGYSLIQGLRCIISMVRGRVLFSKTLAWAIFSGDQVMAYVTVAAAVAAAQSGIFAKVGQTELQWMKICNMYGKFCNQVGEGIASAFVVSLSMVVLSCISAFSLFRLYGGNKIKNVY

SEQ ID NO: 15469 - protein, 203 aa, Glycine max
MSSYLGVGVSPGNVPVYHSTNVNVLDRRIKITELVLRCVILGLGVLAAVLVGTDSQVKEFFSFQKEAKFTDMKSLVFLVVANGLASGYSLIQGLRCIISMIRGRVLFSKPLAWAIFSGDQVMAYVTVATVVAAGQSGVIARVGQPELQWMKICNMYGKFCNQVGEGIASAFVASLSMVVLSCISAFSLFRLYGGNKTKNVLVG

SEQ ID NO: 15470 - protein, 366 aa, Vigna unguiculata
MLRYLLLLFLLGLGARVESHEESGPWSCNSESEIRVEANFKPGVITLDGHADDWKDIDGSYFPLLPALDPDAENEFKGGKMSVKSVHDGRDIFFLLQVDGDYAYSKGESKKCPSVALMFQIGDGASYHNMGGCEEHSTSCTNKTCKGHEVDIMHFSIGSAIPGRLYGGNPLDNRDGNGGDRFGHLVDLYAWNPHCRYLDGTGPPGSANDSSAQNDWKGAWWHSSFTVHSGFVEDESPYTDNGKKGTYFFEFSRPLRTMDHLQQDVQFNIGGSSKMSVGFWYPVDGQPWHGSGHYSVNCDWVPVDISVGGSLSGNSVDAASSSSWNVASAFSVILSVAALCVSVFVSYRVFNPKSVVSFTPLESNNL

SEQ ID NO: 15471 - protein, 365 aa, Glycine max
MLRYLLVFFLLGLGTRVESHEESGHWSCESESEIRVETEFKPGVITLDGHADDWKDIDGSYFPLLPALDPDAENEFKGGKMSVKSVHDGRDIFFLLQVDGDYAYSKGESNKCPSVALMFQIGDSASYHDMGGCKEHSTSCTDKTCKGHEVDIMHFSIGSAIPGRLYGGNPLDNRDGNGGDRFGHLVDLYAWNPHCRYLDGIGPPGSANDSSAQNDWKGAWWHSSFTVHSGFVEDESPYADNGKKGTYFFEFSRSLRTMDHLQQDVQFNIGGSSKMSVAFWYPVDGQPWHGSGHYSVYCDWVPIDISVGKSLNGKSVDAASNSSWNVASAFSVILSVAALCVSVFVSYRVFSPKSVSFTPIENNNL

SEQ ID NO: 15472 - protein, 365 aa, Glycine max
MLRYLLMFFLLGLGTRVESHEESGHWSCESESEIRVEAEFKYGVITLDGHTDDWKDIDGSYFPLLPALDPDAENEFKGGKITVKSVHDGRDIFFLLQVDGDYAYSKGESNKCPSVALMFQIGDGASYHNMGGCEEHPTSCTDKSCKGHEVDIMHFSIGSAIPGRLYGGNPLDNRYGNGGDRFGHLVDLYAWNPHCRYLDGIGPPGSANDSSAQNDWKGAWWHSSFTVHSGFVEDESPYADNGKKGTYFFEFSRPLRTMDHLQQDVQFNIGGSSKMSVAFWYPVDGQPWHGSGHYSIYCDWVPIDISVGNSLSGKSVDAASSSSWNVASAFSVILSVAALCVSVFVSYRVFSPKSVSFTPIENNNL

SEQ ID NO: 15473 - protein, 362 aa, Cicer arietinum
MLPNLFLVLVLLFARVYSHEESGPWTCESGSEIRVESEFEPGVITLDGHADDWKDIDGSHFSLLLALDPDAENEFNGGKMTVKSVHDGRDIFFLLQVDGDYAYSNGEGNKCPSVALMFQIGDDASYHNMGGCEEHTTSCTNKTCKGHEVDIMHFSIGNAIPGRLYGGNPVDNRDGNGGDRFGHLVDLYAWNPHCRYLDGNGPSDSVNDSSAQNDWKGAWWHSSFTVHSGFVEDESPYAENGKKGTYFFEFSRPLRTMDHLQQDVQFTIGGSSKMSVAFWYPIDGQPWHGSGHYSVNCDWVPIDISQGSSLSVKSVDPTSSSSWNVASAFSLILSVAALCVSVFASYRVFHPNSVPFTPMENL

SEQ ID NO: 15474 - protein, 365 aa, Medicago truncatula
MFRYILVLLLLLLVSSYDVYSHEESGPWSCETGSEIHVESEFQPGVITLDGHADDWKDIDGSHFSLLLALDPDAENEFNGGKMTVKSVHDGRDIFFLLQVDGDYAYSNGESKKCPSVALMFQIGDGASYHNMGGCEEHSTSCTNKTCKGHEVDIMHFSIGNAIPGRLYGGNPIDNRDGNGGDRFGHLVDLYAWNPHCRYLDGTGPSGSVNDSSAQNDWKGAWWHSSFTVHSGFVKDENPYAENGKKGTYFFEFSRPLRTMDHLQQDVQFTIGGTSKMSVGFWYPVDGKPWRGSGHYSVNCDWVPIDISQSSSLSGKSVETASSSSWNFASAFSLILSVAALCVSVFVSYRVLHPKSVAFTPMENL

SEQ ID NO: 15475 - protein, 366 aa, Lupinus angustifolius
MFRDLFVLSLLLLASILGGLDSHEESGEWRCESESEIRVESGFKPGVITLDGHADDWKEIDGSHFSLLPALDPDSENEFKGGKLILKSVHDGHDVFFLLQVDGDYAYSKGESNKCPSIALMFQIGDSATYHNMGGCEEHPASCTSKTCKGHEVDIMHFSIGNAIPGRLYGGSPLDNRDENGGDRFGHLDDIYAWNPHCRYFDGTGPSGSANDSSAQNDWKGAWWHSSFTVHSGFVEDESPYAENGKKGTYYFEFSRPLRTMDHLQQDVQLTIGGSSKMSVAFWYPLDGQPWHGSGHYSINCDWVPIDISLGSSFSDKSVNTESSSSWNIASAFSLILSVTALCVSVFVSYRVFNPKSVAYTPTEEL

SEQ ID NO: 15476 - protein, 366 aa, Lupinus angustifolius
MFHYPFVLSLLLASFILGGVESHQESGEWRCESESEIRVYSDFKPGVITLDGHADDWKDIDGSQFSLLPALDPHAENEFKGGKMIIKSVHDGHDVFFLLQVDGDYAYSKGEGNKCPSVALMFQIGDSATYHNMGGCEEHSTSCTDKTCKGHEVDIMHFSIGNAIPGRLYGGNLLDNRDGNGGDRFGHLVDVYAWNPHCRYLDGIGPSGSANDSSAQNDWKGAWWHSSFTVQSGFVADESPYAENGKQGTYFFEFSRPLRTMDHLQQDVQFTIGGSTKMAIAFWYPVDGQPWHGSGHYSVNCDWVPIDVSSDAYLSDKSVNTGSSSSWNIASAFSLILSVAALCVSVFVSYRVFNPKNVGYTPTGNL

SEQ ID NO: 15477 - protein, 483 aa, Glycine max
MALKFLNKKGWHTGSLRNIENVWKAEQKHEAEQKKLEELRKQIQEERERTEFRLLQEKAGLVPHQERLEFLYDSGLSVGKSANSEGFKALEQLPKSDATDAAGAGSSASASKEGASVLGALFEEKPQSANDAWRKLHSDPLLMIRQREQEALAKIKNNPVQMAIIKKSIEGTENKEKVYKKEKRKKHWSSKSKHKKQSDSEDDTTERRKRKTGNEVSDKKHHKAQSDSEYQSSEGEMRRRKDRYEDKKYRERSPSHQQRQRNGKDYKEDAGDRNYNRSRSERSVQKGQLDSGYESSEGEKRRKNYYEGKKCRERSPNHQQRQRNGRDYKEDTGDRNYNTSKSERYASEGWSNIDAPKSGGGRISEASSNRYSASSPEHGSHYKCRNVAPKLSEEERAVKLKQMQLAAELHEEQRWKRIKKAEESDTKEAIQNDNVCGKNFLDTVQKSVYGAAEGGSTSIAESVRRRTYYSQGRSGGEGNAFRR

SEQ ID NO: 15478 - protein, 219 aa, Vigna unguiculata
MATSTMDVLHFQHTPFYCEENVYLLCKKLCSDGVAEAEGSDLFVVFISNEKKQIPLWNQKASKRADGVILWDYHVICIQIKQGNVPPLVWDLDSTLPFPSPLPLYVSETIRPSFQLFSDYNRLFRVVHAPLFLRSFASDRRHMKDSGGKWIEEPPPHEPIIAEDGTVHNLNEYINISVADAITDVSISSVKDVIFTQKNGVVIKDNQLEEFICQLSSLE

SEQ ID NO: 15479 - protein, 219 aa, Glycine max
MATSTMDILHFHHTPFYCEENVYLLCKKLCNDGIANADGSDLFVAFISNEKKQIPLWNQKASKRADGVILWDYHVICIQIKQGAVPPLVWDLDSTLPFPSPLPSYVSETIRPSFQLFSDYNRLFRVVHAPLFLRCFASDRRHMKDSGGNWIEEPPQHEPIVAEDRTVHNLNEYINISAADAITDVTISSVKDAISTQTHGVVIKENQLEEFICQLSSLQ

SEQ ID NO: 15480 - protein, 218 aa, Cicer arietinum
MATSSTMDVSHFHHTPFYCEENVYLLCKKLCNDGITNSEGSDLFVAFISNEKKQIPLWNQKASKRADGVILWDYHVICIQINKEGDAPLVWDLDSTLPFPSPLASYMSETIRPSFQLFADYNRLFRIVHAPIFLRCFASDRRHMKVSDGHWIEEPPPHKPIVAEDGTVHNLDEYFNISGSDAIADIKSSSVKDTVFAQKHGVVIKENQLEELFSQISL

SEQ ID NO: 15481 - protein, 219 aa, Medicago truncatula
MAATSTMDVSLFHHTPFYCEENVYLLCKKLCSDGIANSEGSDLFVAFISNDKKHIPLWNQKASQRADGVILWDYHVICIQTNQGGGLPLVWDLDSTLPFPSPLPSYVSETIRPSFQLFSDYNRLFRIVHAPIFLRCFASDRRHMKGSDGHWIEQPPPHQPIVAQDGTVHNLNEYFNISSSDATADVRTGSVKDALFTQKHGVVIKENQLEELFSQISLQ

SEQ ID NO: 15482 - protein, 1124 aa, Lupinus angustifolius
MDPESTQLQQSQLAAILGPDPTHFETLISHLMSSSNDQRSHAETLFNLCKQNDPNTLSLKLAQLLHSSPHLEARAMSAILLRKQLTRHHNEADESNYLWPRLNANTQSTLKSILLSSLQSEQTKSISKKLCDTVSELASGILPDNGWPELLPFMFQCVSASDSPKLQESAFLIFAQLSQYIGDSLVPHIKHLHAIFLQCLTSPAVDSDVRIAALNAVINFIQCLSGSADRDRFQDLLPAMMRTLTEALNLGQEATAQEALELMIELAGTEPRFLRRQLAEVVGAMLQIAEAESLEEGTRHLAIEFVITLAEARERAPGMMRKLPQFISRLFAILMKMLLDIEDDPAWHSAETEDEDAGETSNYSVGQECLDRLAISLGGNTIVPVASEQLPAYLAAPEWQKRHAALIALAQIAEGCSKVMIKNLEQVVAMVLNSFPDQHPRVRWAAINAIGQLSTDLGPDLQNQYHPGVLPALAAAMDDFQNPRVQAHAASAVLNFSENCTPDILTPYLDGIVSKLLVILQNGKQMVQEGALTALASVADSSQEHFKKYYDAVMPYLKAILINATDKSNRMLRAKSMECISLVGMAVGKEKFRDDAKQVMEVLMSLQGSQMETDDPTTSYMLQAWARLCKCLGQDFLPYMAFVMPPLLWSASLKPDVTITSADSDNDIDDSDDESMETITLGDKRIGIKTSVLEEKATACNMLCCYADELKEGFFPWIDQVTGILVPLLKFYFHEEVRKAAVSAMPELLRSAKLAIEKGQSQGRDASYLKFLTDSIVPALVEALHKEPDTEICASMLDSINESLQISGMLLDENQVRSIVDELKQVITASSSRKSERQERANAEDFDAEEGELIKEENEQEEEVFDQVGEILGTLIKTFKASFLPFFDELSSYLTPMWGRDKTPEERRIAICIFDDVAEQCREAALKYYDTYLPFLLEACNDEIPDVRQAAVYGLGVCAEFGGSVFKPLVGESLSRLNAVIQHPNALHGDNIMAYDNAVSALGKICQFHRDSIDSAQVVPAWLNCLPIKGDLIEAKVVHDQLCSMVERSDRDLLGPNSQYLPKIVSVFAEVLCAGKELATEQTVGRMINLLRQLQQTLPPATLASTWSSLQPQQQLALQSILSS

SEQ ID NO: 15483 - protein, 1124 aa, Lupinus angustifolius
MDPESTQLQQSQLASILGPDPTPFETLISHLMSSSNDQRSHAESLFNLCKQNDPNTLSIKLAYLLQSSPHHEARAMSAILLRKQFTRLHSEIDDSNYLWPRLNGNTQSTLKSLLLSSLQAEQTKSISKKLCDTVSELASGIVPDNGWPELLPFMFQCVSSSDSPKLQESAFLIFAQLSQYIGDSLVPHIKHLHAIFLQCLTSSAVDSDVRIAALNAVINFIQCLSGSGDRDRFQDLLPAMMRTLTEALNSGQEATAQEALELLIELAETEPRFLRRQLAEVVGAMLQIAEAESLEEGTRHLAIEFVITLAEARERAPGMMRKLPQFISRLFAILMKMLLDIEDDPAWHSAETEDEDAGETSNYSMGQECLDRLAISLGGNTVVPVASEQLPAYLAAPEWQKRHAALIALAQIAEGCSKVMIKNLEQVVAMVLNSFPDQHPRVRWAAINAIGQLSTDLGPDLQIHYHQGVLPALAAAMDDFQNPRVQAHAASAVLNFSENCTPDILTPYLDGIVSKLLVILQNGKQMVQEGALTALASVADSSQEHFKKYYDAVMPYLKAILINANDKSNRMLRAKSMECISLVGMAVGKEKFRDDAKQVMEVLMSLQVSQMETDDPTTSYMLQAWARLCKCLGQDFLPYMTFVMPPLLWSASLKPDVTITSADSDNDIDDSDDESMETITLGDKRIGIKTSVLEEKATACNMLCCYADELKEGFFPWIDQVAGILVPLLKFYFHEEVRKAAVSAMPELLRSAKLAIEKGQSQGRDGTYLKFLTDSIVPALVEALHKEPDTEICASLLDSLNESLQISGTLLDENQVRSIVDVLKQVITASSSRKREREERAKAEDFDAEEGELIKEENEQEEEVFDQVGEILGTLIKTFKASFLPFFDELSSYLTPMWGRDKTPEERRIAICIFDDVAEQCREAALKYYETYLPFLLEACNDEIPDVRQAAVYGLGVCAEFGGSVFKPLVGEGLSRLNAVIQHPNALQGDNVMAYDNAVSALGKICQFHRDSIDSAQVVPAWLNCLPIKGDLIEAKVVHDQLCSMVERSDGDLLGPNSQYLPKIVSVFAEVLCAGKELATEQTVGRMINLLRQLQQTLPPATLASTWSSLQPQQQLALQSILSS

SEQ ID NO: 15484 - protein, 1116 aa, Vitis vinifera
MDPESTQLQQAQLAAILGPDPGPFETLISHLMSTSNDQRSHAELLFNLCKQSDPNSLSLKLAHLLQFSPHIEARAMAAILLRKQLTRDDSYLWPRLSASTQSSLKSILLGCIQREDAKSISKKLCDTVSELASSILPENGWPELLPFMFQCVTSDSAKLQEAAFLIFAQLAQYIGETLVPHIKHLHSVFLQSLTSSSSSDVKIAALSAAINFIQCLSSSADRDRFQDLLPAMMRTLTEALNCGQEATAQEALELLIELAGTEPRFLRRQLVDVVGSMLQIAEAESLEEGTRHLAVEFVITLAEARERAPGMMRKLPQFISRLFAILMKMLLDIEDDPAWHSADSEDEDAGESSNYSVGQECLDRLAISLGGNTIVPVASELLPAYLAAPEWQKHHAALIALAQIAEGCSKVMIKNLEQVVTMVLNTFQDPHPRVRWAAINAIGQLSTDLGPDLQVQYHQRVLPALAASMDDFQNPRVQAHAASAVLNFSENCTPDILTPYLDGIVGKLLVLLQNGKQMVQEGALTALASVADSSQEHFQKYYDAVMPYLKAILMNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTITSADSDNEIEESDDESMETITLGDKRIGIKTSVLEEKATACNMLCCYADELKEGFFPWIDQVAPTLVPLLKFYFHEEVRKAAVSAMPELLRSAKLAVEKGLAQGRNESYVKQLSDYIIPALVEALHKEPDTEICASMLDALNECLQISGRILDESQVRSIVDEIKQVITASSSRKRERAERTKAEDFDAEEGELLKEENEQEEEVFDQVGEILGTLIKTFKASFLPFFDELASYLTPMWGKDKTAEERRIAICIFDDVAEQCREAALKYYDTYLPFLLEACNDDNSDVRQAAVYGLGVCAEFGGAAFKPLVGEALSRLNVVIRHPNALQPDNVMAYDNAVSALGKICQFHRDSIDSAQVVPAWLSCLPIKGDLIEAKVVHDQLCSMVEMSDRELLGPNNQYLPQIVAVFAEVLCAGKDLATEQTISRMINLLRQLQQTLPPSTLASTWSSLQPQQQLALQSILSS

SEQ ID NO: 15485 - protein, 1116 aa, Tabernaemontana elegans
MDAGSTQMQQAQLAAILGPDLAPFETLISHLMSSSNDQRSQAESIFNLIKQNDPNSLVLKLAQLLSSSPHVEARAMSTILLRKQLTRDDSYIWPRLTVSTQSTIKSILLSCIQNENSKSIIKKLCDTISELASSILPENNWPEILPFMFQCVTSDSVKLQESAFLIFSQLAQYIGDTLIPYIKDLHAVFLQVLNNSPSSDVKIAALSAVINFIQCLTSPSDRDRFQDLLPAMMRTLTEALNCGQEATAQEALELLIELAGTEPRFLRRQLVDVVGSMLQIAEAEGLEEGTRHLAIEFVITLAEARERAPGMMRKLPQFISRLFAILMKMLLDVEDEPAWHSAEPDDEDAGETSNYSVGQECLDRLSIALGGNTIVPVASEQLPAYLAAPEWQKHHAALIALAQIAEGCSKVMIKNLEQVVNMVLNSFQDPHPRVRWAAINAIGQLSTDLGPDLQVQYHQRVLPALAAAMDDFQNPRVQAHAASAVLNFSENCTPEILTPYLDGIVSKLLVLLQNGKQMVQEGALTALASVADSSQEHFQKYYDAVMPYLKTILVNATDKSNRMLRAKAMECISLVGMAVGKEKFRNDAKQVMEVLMSLQGSQMETDDPTTSYMLQAWARLCKCLGQDFLPYMSVVMPPLLQSAQLKPDVTITSADSDNEIDESDDESMETITLGDKRIGIKTSVLEEKATACNMLCCYADELKEGFYPWIDQVAPTLVPLLKFYFHEEVRKAAVSAMPELLRSAKLAIEKGIAQGRNETYLKQLSDFIIPALVEALHKEPDTEICAAMLDALNECLQISGPLLDESQVRSIVDEVKQVITASSSRKRERAERAKAEDFDAEEGELLKEENEQEEEVFDQVGEILGTLIKTFKAAFLPFFDELSSYLMPMWGKDKTPEERRIAICIFDDVAEQCRETALKYYDTYLPFLLEACNDENPDVRQAAVYGLGVCAEFGGSVFKPLVGEALSRLNVVIQHPNALQPDNVMAYDNAVSALGKICQFHRDSIDSAQVVPAWLNCLPIKGDLIEAKAVHDQLCSMVERSDRELLGPNNQHLPKIVSVFAEVLCAGKDLATEQTASRMINLLRQLQQTLPPSALASTWSSLQPQQQLALQSILSS

SEQ ID NO: 15486 - protein, 1117 aa, Panax ginseng
MDSSQSTQIQQAQLAAILGPDPAPFETLISHLMASSNEQRSQAELIFNLCKQSDPNSLVLKLAHLLQFSPHVEARAMSAILLRKQLTRDDSYIWPRLSPSTQSSLKSFFLSCVQREEAKTIIKKLCDTISELASGILPDNGWPELLPFMFQCVSSDSHKLQESAFLIFAQLSQYIGETLIPHIKHLHTVFLQCLTSSSSSDVRIAALSAVINFIQCLSSSSDRDRFQDLLPAMMRTLTEALNCGQEATAQEALELMIELAGTEPRFLRRQLVEVVGSMLQIAEAETLEEGTRHLAIEFVITLAEARERAPGMMRKLPQFISRLFAILMKMLLDIEDDPAWHLADTEDEDAGETSNYSVGQECLDRLAIALGGNTIVPVASEQLPAYLAAPEWQNHHAALIALAQIAEGCSKVMIKNLEQVVTMVLNSFQDPYARVRWAAINAIGQLSTDLGPDLQVQYHQRVLPALAAAMDDFQSPRVQAHAASAVLNFSENCTPDILTPYLDGIVSKLLVLLENGKQMVQEGALTALASVADSSQEHFQKYYDAVMPYLKAILVNANDKSNRMLRAKAMECISLVGMAVGKEKFRDDAKQVMEVLMSLQGSQMETDDPTTSYMLQAWARLCKCLGQDFLPYMSVVMPPLLQSAQLKPDVIITSADSDNEIDESDDDSMETITLGDKRIGIKTSVLEEKATACNMLCCYADELKEGFYPWIDQVAPTLVPLLKFYFHEEVRKAAVSAMPELLRSAKLAVEKGLAQGRNESYIKQLSDYIIPALVEALHKEPDTEICANMLDALNECVQISGPILDEGQVRSIVDEIKQVITASSSRKKERAERAKAEDFDAEEGELLKEENEQEEEVFDQVGEILGTLIKTFKASFLPFFDELSSYLMPMWGKDKTAEERRIAICIFDDVAEQCREAALKYYDTYLPFLLEACNDENSDVRQAAVYGLGVCAEYGGSVFKPLVGEALSRLNVVIRHPNALQPDNVMAYDNAVSALGKICQFHRDSIDSAQVLPAWLSCLPIKGDLIEAKVVHDQLCSMVERSDTELLGPNNQYLSKIVSVFAEVLFAGKDLATEQTASRMINLLRQLQQTLPPSTLASTWSSLQPQQQLALQSILSS

SEQ ID NO: 15487 - protein, 1114 aa, Populus trichocarpa
MDESTQLQQAQLAAVLGGDPSQFETLISSLMSSSNETRSQAELIFNLAKQHDPNSLCLKLAHLLQFSPHLDARAMSAVLLRKLLTRDDSYLWPRLSPQTQSSLKSILLACLQQESVKSNTKKLCDTVSELASGILPDNGWPELLPFMFQCVTSDSFKLQESAFLIFAQLSQYIGESLIPFIKELHGVFLQCLGSSTNFDVKIAALNAVINFIQCLDNSSDRDRFQDLLPSMIRTLTEALNNGNEATAQEALELLIELAGTEPRFLRRQLVDVVGSMLQIAEAESLEEGTRHLAIEFVITLAEARERAPGMMRKLPQFISRLFGILMRMLLDIEDDPAWHSAENEDEDAGETSNYSVGQECLDRLAISLGGNTIVPVASEQLPAYLAAPEWQKHHAALIALAQIAEGCSKVMLKNLEQVVTMVLNSFYDPHPRVRWAAINAIGQLSTDLGPDLQNQYHQRVLPALAAAMDDFQNPRVQAHAASAVLNFSENCTPEILTPYLDGVVSKLLVLLQNGKQMVQEGALTALASVADSSQEHFQKYYDAVMPYLKTILVNANDKANRMLRAKSMECISLVGMAVGKEKFRDDAKQVMDVLLSLQVSQMESDDPTTSYMLQAWARLCKCLGQDFLPYMSVVMPPLLQSAQLKPDVTITSADSDNDIDDSDDESMETITLGDKRIGIKTSVLEEKATACNMLCCYADELKEGFFPWIDQVAPTLVPLLKFYFHEEVRKAAVSAMPELLRSAKLAIEKGLAQGRNESYVKQLSDYIIPALVEALHKEPDTEICASMLDALNECLQISGVLVDEGQVRSVVDEIKLVITASSSRKRERAERAKAEDFDAEEGELIKEENEQEEEVFDQVGEILGTLIKTFKASFLPFFDELSSYLTPMWGKDKTAEERRIAICIFDDVAEQCREAALKYYDTYLPFLLEACNDDNPDVRQAAVYGLGVCAEVGGSVFKHLVGEALSRLNVVIRHPNAKQPDNVMAYDNAVSALGKICQFHRDSIDSAQVVPAWLNCLPITGDLIEAKAVHEQLCSMVERSDRELLGPNNQYLPKIVSVFAEVLCGKDLATEQTLSRMVNLLRQLQQTLPPATWASTLSVLHPQQQMALQSILSS

SEQ ID NO: 15488 - protein, 645 aa, Panax ginseng
MDSSQMQQAQLAAILGPDPAPFETLISHLMASSNEQRSQAEVIFNLCKQTDPNSLVLKLAQLLQFSPHVEARAMSAILLRKQLTRDDSYIWPRLSPSTQSSLKSIFLACVQCEEAKTIIKKLCDTVSELASGILPDNGWPELLPFMFQCVSSDSHKLQESAFLIFAQLSQYIGETLIPHIKHLHTVFLQCLTTSSSSDVRIAALSAVINFIQCLSSSSDRDRFQDLLPAMMRTLTEALNCGQEATAQEALELMIELAGTEPRFLRRQLVEVVGSMLQIAEAETLEEGTRHLAIEFVITLAEARERAPGMMRKLPQFISRLFAILMKMLLDIEDDPAWHLADTEDEDAGETSNYSVGQECLDRLAIALGGNTIVPVASEQLPAYLAAPEWQNHHAALIALAQIAEGCSKVMIKNLEQVVTMVLNSFQDPYARVRWAAINAIGQLSTDLGPDLQVQYHQRVLPALAAAMDDFQSPRVQAHAASAVLNFSENCTPDILTPYLDGIVSKLLVLLENGKQMVQEGALTALASVADSSQEHFQKYYDAVMPYLKAILVNANDKSNRMLRAKAMECISLVGMAVGKEKFRDDAKQVMEVLMSLQGSQMETDDPTTSYMLQAWARLCKCLGQGFPSLYECSHASLASVCSTET

SEQ ID NO: 15489 - protein, 1113 aa, Lactuca sativa
MDPQVQQAQLAAILGADPAPFETLISHLMSSSNEQRSQAELIFNLCKQTDPNSLFLKLGHLLQLSPHMEARAMSAILLRKQLTQDDSLVWNRLSPTTQVSLKSILLACVQQEEAKTIMKKLCDTISELASSILPDNGWPELLPFMFQCVSSDSPKLQESAFLIFAQLSQYIGETLIPHIKHLHGVFLQCLTTSGSSDVRIAALSAVINFIQCLSSSGDRDRFQDLLPAMMTTLTEALNGGQEATAQEALELLIELAGTEPRFLRRQLVEVVGSMLQIAEAETLEEGTRHLAIEFVITLAEARERAPGMMRKLPQFISRLFCILLQMLLDVEDEPAWHTAENEDEDAGESSNYSVGQECLDRLAIALGGNTIVPVASEQLPAYLAAPEWQKHHAALIALAQIAEGCSKVMIKNLEQVVSMVLNSFQDPHPRVRWAAINAIGQLATDLGPDLQVQYHQRVLPALANAMDDFNNPRVQAHAASAVLNFSENCTPDILTPYLDGIVSKLLVLLQNGKQMVQEGALTALASVADSSQEHFQKYYDAVMPYLKAILVNANDKANRMLRAKAMECISLVGMAVGKEKFRDDAKQVMEVLMSLQGSQMETDDPTTSYMLQAWARLCKCLGQDFLPYMSVVMPPLLLSAQLKPDVIITSAASDNELDESDDESMETITLGDKRIGIKTSVLEEKATACNMLCCYADELKEGFYPWIDQVAPTLVPLLKFYFHEEVRKAAVSAMPELLRSAKLAIEKGLAQGRNESYIKQLSDYIVPALVEALHKEPDTEICASMLDALNECIQVSGTLLDENQVRSIVDEIKQVITASSSRKTERAERAKAEDFDAEEGELLKEENEQEEEVFDQIGEILGTLIKTFKASFLPFFDEMSSYLMPMWGKDKTAEERRIAICIFDDVAEQCREAALKYYDTYLPFLLEACNDESPDVRQAAVYGLGVCAEYGGSVIKPLVGEALSRLNVVIRHPNAVHPENVMAYDNAVSALGKICHFHRDSIDSAQVIPAWLSCLPIKGDLIEAKVVHELLCSMVERSDAVLLGPNNQYLPKIVSVFAEIICGGKDLATEQTINRIVNLLRQLQQTLPPATFASTWSSLQPQQQLALQSVLTS

SEQ ID NO: 15490 - protein, 1111 aa, Solanum lycopersicum
MAAEQAQLAAILGPDSAPFETLISHLMSASNEQRSQAESIFNLIKQNDPNSLALKLANLLSSSPHHEARAMSTILLRKLLTRDDSFIWPRLTESTQSGIKSVLLRCIQHEESKSIIKKLCDTISELASSILPENNWPELLPFMFQCVTSDVPKLQESAFLIFALLAQYVGEMLVPYIKDLHTVFMQTLNNSPNPDVRIAGLSAVINFIQCLSSSNDRDRFQDLLPAMMKTLTEALNSGQEATAQEALELLIELAGTEPRFLRRQLVDVVGAMLQIAEAESLEEGTRHLAIEFVITLAEARERAPGMMRKLPQFISRLFAILMKMLLDIDDEPVWHSAEVEHEDAGETSNYSVGQECLDRLSIALGGSTIVPVASEQLPPYLAAPEWQKHHAALIALAQIAEGCTKVMIKNLEQVVNMVLSCFQDPHPRVRWAAINAIGQLSTDLGPDLQVQYHSRVLPALATAMDDFQNPRVQAHAASAVLNFSENCTPEILTPYLDGIVSKLLVLLQNGKQMVQEGALTALASVADSSQEHFQKYYDAVMPYLKTILVNANDKSNRMLRAKAMECISLVGMAVGKDKFRDDAKQVMEVLMSLQGSQMETDDPTTSYMLQAWARLCKCLGQDFLPYMSVVMPPLLLSAQLKPDVTISSADSDNELDDSDDDSMETITLGDKRIGIKTSVLEEKATACNMLCCYADELKEGFYPWIDQVAPTLVPLLKFYFHEEVRKAAVSAMPELLRSAKLAVEKGIAQGRNETYVKQLSDYIIPALVEALHKEPDTEICASMLDALNECVQISGPLLDEGQVRSIVDEIKQVITASSSRKRERAERAKAEDFDAEESELLKEENEQEEEVFDQVGEILGTLIKTFKAVFLPFFDELSSYLMPMWGKDKTAEERRIAICIFDDIAEQCREAALKYYDTYLPFLLEACNDESPDVRQAAVYGLGVCAEYGGSVIKPLVGEALSRLNVVIGHPNALQPENVMAYDNAVSALGKICQFHRDSIDSAQVVPAWLNCLPIKGDLIEAKVVHDQLCSMVERSDVELLGPNNQNLPKIVSVFAEVLCTGKDLATEQTASRMINLLRQLQQTLPPATLASTWSSLQPQQQIALQSILSS

SEQ ID NO: 15491 - protein, 631 aa, Vinca minor
MDSESTQLQQAQLVAILVPDLAPFETLISHLMSTINEQRSQAESIFNLIKQTDPNSLALKLAQLLSSSPHVEARAMSTILLRKQLTRDDSYIWPRLSVSTQSTIKSILLSCIQNEESKSIIKKLCDTISELASSILPENNWPEILPFMFQCVTSESHKLQESAFLIFSQLAQYIGETLTPFIKDLHAVFLQVLNNSPNSYVKIAALSAVINFIQCLNSPSDRDRFQDLLPAMMKTLTEALNCGQEATAQEALELLIELAGTEPRFLRRQLVDVVGSMLQIAEADGLEEGTRHLAIEFVITLAEARERAPGMMRKLPQFISRLFAILMTMLLDVEDDPAWHSAEPEDEDAGETSNYSVGQECLDRLSIALGGNTIVPVASEQLPAYLAAPEWQKHHAALIALAQIAEGCSKVMIMNLEQVLSMILNSFQDPHPRVRWAAINAIGQLSTDLGPDLQVQYHNRVLPALGHSMDDFQNPRVQAHAASAVLNFSENCTPEILTPYLDGVVSKLLVLLQNGKQMVQEGALTALASVADSSQEHFQKYYDAVMPYLKTILVNATDKSNRMLRAKAMECISLVGMAVGKESLGKTQSRLWRCSCHFKDHNWKPMIPPPVTCCRHGPDSANAWDKIFFLT

SEQ ID NO: 15492 - protein, 1114 aa, Populus trichocarpa
MDESTQFQQSQLAAILAGDPSQFEILISSLMSSSNETRSQAELLFNLAKQHDPNSLSLKLAQLLQFSPHLDARAMSAVLLRKLLTRDDSYLWPRLSLQTQSSLKSILLACLQQESVKSITKKLCDTVSELASGILPDNGWPELLPFMFQCVTSDSVKLQESAFLIFAQLSQYIGESLVPYIKELHGVFLQCLGSSTNFDVKIAALNAVTNFIQCLNNTSERDRFQDLLPSMIRTLTEALNNGNEATAQEALELLIELAGAEPRFLRRQLVDVVGSMLQIAEAEGLEEGTRHLAIEFVITLAEARERAPGMMRKLPQFISRLFAILMSMLLDIEDDPAWHSAENEDEDAGESSNYSMGQECLDRLAISLGGNTIVPVASEQLPAYLAAPEWQKHHAALIALAQIAEGCSKVMLKNLEQVVTMVLNSFYDPHPRVRWAAINAIGQLSTDLGPDLQNQYHQRVLPALAAAMDDFQNPRVQAHAASAVLNFSENCTPEILTPYLDGVVSKLLVLLQNGKQMVQEGALTALASVADSSQEHFQKYYDAVMPYLKTILVNANDKANCMLRAKSMECISLVGMAVGKDKFRDDAKQVMDVLMSLQGSQMESDDPTTSYMLQAWARLCKCLGQDFLPYMSVVMPPLLQSAQLKPDVTITSADSDNDIDDTDDESMETITLGDKRIGIKTSVLEEKATACNMLCCYADELKEGFFPWIDQVAPTLVPLLKFYFHEEVRKAAVSAMPELLRSAKLAVEKGLAQGRNESYIKQLSDYIIPALVEALHKEPDTEICANMLDALNECLQISGTFVDENQVRSIVDEIKLVITASSSRKRERADRAKAEDFDAEESELIKEENEQEEDVFDQVGEILGTLIKTFKASFLPLFEELSSYLTPMWGKDKTAEERRIAICIFDDVAEQCREAALKYYDTYLPFLLEACNDENPDVRQAAVYGLGVCAEFGGSVFKSLVGEALSRLNVVIRHPNAKQPDNVMAYDNAVSALGKICQFHRDSIDSAQVVPAWLNCLPITGDLIEAKVVHEQLCSMVERSDIELLGPNNQYLPKIVSVFAEVLCGKDLATEQTLSRMVNLLRHLQQTLPPATLASTLSLLHPQQQLALQSILST

SEQ ID NO: 15493 - protein, 1112 aa, Ambrosia trifida
MDPQVQQAHVAAILGSDPSPFETLISHLMSSSNDQRSQAELIFNLCKQTDPNRLFLKLGHMLQSSQHIEARAMSAILLRKQLTQDELLIWNRLSPESQSLIKSILLSCVQKEETNSIMKKLCDTVSELASSILPDNGWPELLPFMFQCVVSDNYKLQESAFLIFAQLSQYIGETLIPHIKHLHGVFLQCLTTSPSSDVRIAALSAVINFIQCLSSGDRDRFQDLLPAMMTTLTEALNGGQEATAQEALELLIELAGTEPRFLRRQLVEVVGSMLQIAEAETLEEGTRHLAIEFVITLAEARERAPGMMRKLPQFISRLFGILLRMLLDIEDEPAWHTAENEDEDAGESSNYSVGQECLDRLAIALGGNTIVPVASEQLPAYLAAPEWQKRHAALISLAQIAEGCSKVMIKNLEQVVSMVLNSFQDPHPRVRWAAINAIGQLATDLGPDLQVQYHQRVLPALANAMDDFQNPRVQAHAASAVLNFSENCTPDILTPYLDGIVSKLLVLLQNGKQMVQEGALTALASVADSSQEHFQKYYDAVMPYLKTILVNANDKANRMLRAKAMECISLVGMAVGKEKFRDDAKQVMEVLMSLQGSQMETDDPTTSYMLQAWARLCKCLGQDFLPYMTVVMPPLLQSAQLKPDVVITSADSDNEIDESDDESMETITLGDKRIGIKTSVLEEKATACNMLCCYADELKEGFYPWIDQVAPILVPLLKFYFHEEVRKAAVSAMPELLRSAKLAIEKGLAQGRNESYIKQLSDYIVPALVEALHKEPDTEICASMLDALNECIQVSGPLLDENQVKSIVDEIKQVITASSSRKTERAERTKAEDFDAEEGELLKEENEQEEEVFDQIGEILGTLIKTFKASFLPFFDDMSSYLMPMWGKDKTAEERRIAICIFDDLAEQCREAAIKYYDTYLPFLLEACNDESPDVRQAAVYGLGVCAEYGGSAIKPLIGEALSRLNVVIRHPNALQPENVMAYDNAVSALGKICQFHRDSIDSTQIIPAWLSCLPIKGDLIEAKVVHELLCSMVERSDMELLGPNNQYVPKIVSVFAEILCAGKDLATEQTINRIVNLLRQLQQTLPPATFASTWASLQPQQQLAIQSVLTS

SEQ ID NO: 15494 - protein, 1087 aa, Amsonia hubrichtii
SHLMSASNEQRSQAESIYNLIKQTDPTRSPSTRSALSSSPHLEVRAMSTILLRKQLTRDDSYIWPRLTVSTQSTIKTILLSCIQNENSKSIIKKLCDTISELASSILPENNWPELLPFMFQCVTSDSVKLQESAFLIFSQLAQYIGETLIPYIKDLHAVFLQVLNNSQSSDVKIAALSAVINFIQCLSSPSDRDRFQDLLPAMMRTLTEALNCGQEATAQEALELLIELAGTEPRFLRRQLVDVVGSMLQIAQAESLEEGTRHLAIEFVITLAEARERAPGMMRKLPQFISTLFAILMKMLLDVEDDPAWHSAEPDHEDAGETSNYSVGQECLDRLSIALGGNTIVPVASEQLPAYLAAPEWQKHHAALIALAQIAEGCSKVMIKNLEQVVNMVLSSFQDPHPRVRWAAINAIGQLSTDLGPDLQVQYHQSVLPALAASMDDFQNPRVQAHAASAVLNFSENCTPEILTPYLDGIVGKLLVLLQNGKQMVQEGALTALASVADSSQEHFQKYYDAVMPYLKTILVNATDKSNRMLRAKAMECISLVGMAVGKEKFRDDAKQVMEVLMSLQGSQMETDDPTTSYMLQAWARLCKCLGQDFLPYMSVVMPPLLQSAQLKPDVTITSADSDNEIDESDDDSMETITLGDKRIGIKTSVLEEKATACNMLCCYADELKEGFYPWIDQVAPTLVPLLKFYFHEEVRKAAVSAMPELLRSAKLAIEKGIAQGRNETYVKQLSDFIIPALVEALHKEPDTEICAAMLDALNECLQISGPLLDESQVRSIVDEIKQVITASSSRKRERAERAKAEDFDAEEGELLREENEQEEEVFDQVGEILGTLIKTFKAAFLPFFDELSSYLMPMWGKDKTPEERRIAICIFDDVAEQCRETALKYYDTHLPFLLEACNDENPDVRQAAVYGLGVCAEFGGSVFKPLVGEALSRLNVVIRHPNALQPDNVMAYDNAVSALGKICQFHRDSIDSAQVVPAWLNCLPIKGDLIEAKAVHDQLCSMVERSDRELLGPNNQYLPKIVSVFAEVLCAGKDLATEQTASRMINLLRQLQQTLPPSALASTWSSLQPQQQLALQSILSS

SEQ ID NO: 15495 - protein, 1115 aa, Eucalyptus grandis
MDPQSAQLQQAQLAMALGPDPSHFETLITHLMSSSNELRSQAESLFNLAKQTDPNSLSLKLAHILHNCPRLELRAMSAILLRKLLTRDDSYIYPRLTPQTQASLKSVLLTSIQREEAKTITKKLCDTVSELASGILPDNGWPELLPFMFQCVSSDVPKLQEAAFLIFAQLAQYIGDSLTPYIKELHGVFLQCLSSSKNPDVKIAALNAVINFIQCLSNSSDRDRFQDLLPVMMHTLTEALNNGNEPTAQEALELLIELAGTEPRFLRRQLVEVVGSMLQIAEAESLEEGTRHLAIEFVITLAEARERAPGMMRKLPQFISRLFAILMKMLLDIEDDPVWHSAESEDEDAGESSNYSVGQECLDRLSISLGGNTIIPVASEQLPAYLAAPEWEKHHAALIAIAQIAEGCAKVMVKTLERVVSMVLTSFQDPHPRVRWAAINAIGQLSTDLGPDLQEQYHQQVLPALAGAMDDFPNPRVQAHAASAILNFSENCTAVILMPYLDGIVSKLLVLLQNGKQMVQEGALTALASVADSSQEQFQKYYDAVMPYLKNILVNATDKSNRMLRAKAMECISLVGMAVGKEKFRDDAIQVMDVLMALQRSQMETDDPTTSYMLQAWARLCKCLGQDFLPYMKVVMPPLLQSAQLKPDVTITSADSDNDIDESDDEGMETITLGDKRIGIKTSVLEEKATACNMLCCYADELKEGFFPWIEQVAPTLVPLLKFYFHEDVRKAAVSAMPELLRSAKLAVEKGLAQGHNETYVKQLTDYIIPALVEAIPKEPDTEICASMLDALNECLQISGPLLDENQVRSIVDEIKQVITASSSRKRERAERAKAEDFDAEEGELLKEENEAEEEVFEQVGEILGTMVKTFKASFLPFFDELSSYLTPMWGKDKTSEERRIAICIFDDVAEQCRETALKYYDTYLPFLLEACNDENPDVRQAAVYGLGVCAEFGGSVFKPLVGEALSRLNVVIRDPNALQPDNVMAYDNAVSALGKICQFHRDSIDSSQVVPAWLNCLPIKGDVIEAKVVHDMLCSMVERSDRELLGPNNQYLPKIVTVFVEVLCGKDLATEQTLNRMTSLLRQLQQTLPPSALASTWSSLQPQQQLALQSILSS

SEQ ID NO: 15496 - protein, 927 aa, Panax ginseng
AEVIFNLCKQTDPNSLVLKLAQLLQFSPHVEARAMSAILLRKQLTRDDSYIWPRLSPSTQSSLKSIFLACVQREEAKTIIKKLCDTVSELASGILPDNGWPELLPFMFQCVSSDSHKLQESAFLIFAQLSQYIGETLIPHIKHLHTVFLQCLTTSSSSDVRIAALSAVINFIQCLSSSSDRDRFHDLLPAMMSTLTEALNCGQEATAQEALELMIELAGTEPRFLRRQLVEVVGSMLQIAEAETLEEGTRHLAIEFVITLAEARERAPGMMRKLPQFISRLFAILMKMLLDLEDDPAWHTADTEDEDAGETSNYSVGQECLDRLAIALGGNTIVPVASEQLPAYLAAPEWQKHHAALIALAQIAEGCSKVMIKNLEQVVTMVLNSFQDPHARVRWAAINAIGQLSTDLGPDLQVQYHQRVLPALAAAMDDFPNPRVQAHAASAVLNFSENCTPDILTPYLDGIVSKLLVLLQNGKQMVQEGSLTALASVADSSQEHLQKYYDAVMPYLKAILVNANDKSNRMLRAKAMECISLVGMAVGKDKFRDDAKQVMEVLMSLQGSQMETDDPTTSYMLQAWARLCKCLGQDFLPYMSVVMPPLLQSAQLKPDVIITSADSDNEIDESDDESIETITLGDKRIGIKTSVLEEKATACNMLCCYADELKEGFYPWIDQVAPTLVPLLKFYFHEEVRKAAVSAMPELLRSAKLAVEKGLAQGRNESYIKQLSDYIIPALVEALHKEPDTEICASMLDALNECVQISGPILDEGQVRSIVDEIKQVITASSSRKKERAERAKAEDFDAEEGELLKEENEQEEEVFDQVGEILGTLIKTFKASFLPFFDELSSYLMPMWGKDKTAEERRIAICIFDDVAEQCREAALKYYDTYLPSFWKHAMMRIRMSDRQPYMDLVFVRNMAVLFSNHLLERLFQG

SEQ ID NO: 15497 - protein, 1112 aa, Nicotiana benthamiana
MAAEQAQLAAILGPDSAPFETLISHLMSASNEQRSQAESSVFNLIKQNDPNALALKLANVLTSSPHQEARAMSTILLRKLLTRDDSFIWPKLTESTQSGIKTVLLTCIQREESKAIIKKLCDTVSELASSILPENQWPELLPFMFQCVTSDLPKLQESAFLIFALLAQYVGEKLVPYIKDLHSVFMQTLNHSPHPDVRIAGLSAVINFIQCLSSSNDRDRFQDLLPAMMKTLTEALNSGQEATAQEALELLIELAGTEPRFLRRQLVDVVGAMLQVAEAVSLEEGTRHLAIEFVITLAEARERAPGMMRKLPQFISRLFAILMKMLLDIEDEPTWHSAEVEHEDAGETSNYSVGQECLDRLAIALGGSTIVPVASEQLAPYLAAPEWQKHHAALIALAQIAEGCTKVMIKNLEQVVNMVLSCFQDPHPRVRWAAINAIGQLSTDLGPDLQVQYHSRVLPALASAMDDFQNPRVQAHAASAVLNFSENCTPEILTPYLDGIVSKLLVLLQNGKQMVQEGALTALASVADSSQENFQKYYDAVMPYLKRILVNANDKSNRMLRAKAMECISLVGMAVGKEKFRDDAKQVMEVLMSLQGSQMETDDPTTSYMLQAWARLCKCLGQDFLPYMSVVMPPLLQSAQLKPDVTISSADSDNELDESDDDSMETITLGDKRIGIKTSVLEEKATACNMLCCYADELKEGFYPWIDQVAPTLVPLLKFYFHEEVRKAAVSAMPELLRSAKLAVEKGIAQGRNESYVKQLSDYIIPALIEALHKEPDTEICASMLDAINECVQISGPLLDEGQVRSIVEEIKQVITASSSRKRERAERAKAEDFDAEENELLREENEQEEEVFDQVGEILGTLIKTFKAAFLPFFDELSSYLMPMWGKDKTAEERRIAICIFDDVAEQCREAALKYYDTYLPFLLEACNDESPDVRQAAVYGLGVCAEYGGSVFKPLVGEALSRLNVVIRHPNALQPENVMAYDNAVSAVGKICQFHRESIDSAQVVPAWLNCLPIKGDLIEAKVVHDQLCSMVERSDRELLGPDNQYLPKIVLVFAEVLCAGKDLATEQTASRMINLLRQLQQTLPPATLASTWSSLQPQQQIALQSILSS

SEQ ID NO: 15498 - protein, 1116 aa, Mimulus guttatus
MDAESTQFQQAQLMAILGPDPAPFETLISHLMSSANEQRSQAESIFNLLKQNDPNSLALKLANLLSSSVHLEARAMATILLRKQLTRDDSFIWPQLTEPTRSAVKNILLSAIQNEESKSIIKKLCDTVSELASSLVPENQWPEILPFMFQSVSSNSPKLQESAFLMFSQLAQFIGETLTPYITDLHTVFLNVLNNSTNPDVKIAALSAVINFIQCLSSSNDRDRFQDLLPSMMKTLTEALNSGQEATAQEALELLIELAGTEPRFLRRQIVDVVGSMLQIAEAESLEEGTRHLAIEFVITLAEARERAPGMMRKLPQFISRVFAILMKMLVDVEDDPAWHSAETKDEDAGETSNYSVGQECLDRLAIALGGNTIVPVASEQLPAYLSATEWQKHHAALIALAQIAEGCSKVMIKNLEQVVTMVLNSFQHPHPRVRWAAINAIGQLSTDLGPDLQVQYHQHVLPALAGAMDDFQNPRVQAHAASAVLNFSENCTPEILTPYLDGIVHKLLLLLQNSKQMVQEGALTALASVADSSQIHFQKYYSAVMPYLKTILVNATDKSNRMLRAKAMECISLVGMAVGKDIFKEDAKQVMEVLMSLQGSQMETDDPTTSYMLQAWARLCKCLGQDFLPYMSVVMPPLLQSAQLKPDVTITSADSDNEIDESDDESMETITLGDKRIGIKTSVLEEKATACNMLCCYADELKEGFYPWIDQVAPTLVPLLKFYFHEEVRKAAVSAMPELLRSAKLAVEKGIAQGRNETYVKQLSDYIVPALVEALHKEPDTEICANMLDAINECLQISGQLLDESQVRSIVDEIKQVITASSSRKRERAERSKAEDFDAEEGELLKEENEQEEEVFDQVGEILGTMIKTFKASFLPFFDELSSYLMPMWGKDKTAEERRIAICIFDDVAEQCRESALKYYDTYLPFLLEACNDENQDVRQAAVYGLGVCAEFGASVIKPLVGEALSRLNVVIRHPNALQPENVMAYDNAVSALGKICQFHRDSIDAAQVIPAWLSCLPIKGDLIEAKVVHEQLCSMVERSDAELLGPNNQYLPKIVSVFAEVLLAGNDLATEQTTSRMINLLRHLQQTLPPSTLASTWASLQPQQQLALQSLLSS

SEQ ID NO: 15499 - protein, 1113 aa, Solanum phureja
MDSESTQQQVAAILGADPAPFETLISHLMSTSNEQRSQAESIFNLIKQNDPNSLAIKLANLLTTSPHIEPRAMSAILLRKLLTRDDDFIWPKLTHSTQSSIKSLLLTCIQHEQSKSIIKKLCDTISELASSILPENQWPEILPFMFHSVTSDSPKLQESAFFIFAQLAQYIGDILVPYTKDLHSVFLQNLNNSSNPDVRIAALSAAINFIQCLAIESQRDRFQDLLPGMMSTLTEALNLGQEATAQEALELMIELAGTEPRFLRRQLVDVVGAMLQIAEAESLEEGTRHLAIEFVITLTEARERAPGMMRKLPQFISRLFAILMKMLLDVEDEVLWHSAEVEHEDAGETSNYSVGQECLDRLAIALGGNTIVPVASEQLPAYLAAPEWQKHHAALIALAQIAEGCSKVMIKNLEQVVNMVLNSFQDPHPRVRWAAINAIGQLSTDLGPDLQVQYHNRVLPALATAMDNFQSPRVQAHAASAVLNFSENCTPEILTPYLDGIVSKLLVLLQNGKQMVQEGALTALASVADSSQEHFQKYYDAVMPYLKTILVNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTISSADSDNELDESDDDSMETITLGDKRIGIKTSVLEEKATACNMLCCYADELKEGFYPWIDQVAPTLVPLLKFYFHEEVRKAAVSAMPELLRSAKLAVEKGIAQGRNETYVKQLSDYIIPALVEALHKEPDTEICASMLDALNECLQISGLLLDEGQVRSIVDEIKQVITASSSRTSERAERAKAEDFDAEEGELLREENEQEEEVFDQVGEILGTLIKTFKAAFLPFFDELSSYLMPMWGKDKTAEERRIAICIFDDVAEQCREAALKYYDTYLPFLLEACNDESPDVRQAAVYGLGVCAEHGGSAFKSLVGEVMSRLYVVLRHPNAIQPENIMAYDNAVSALGKICNFHRDSIDSAQVIPAWLNCLPIKDDLIEAKVVHDQLCSMVERSDRELLGPNNEYLPKVVQIFAEVLCAGRDLVTEQTASRMITLLRQLQQTLPPATLASIWSSLQPQQQLTLQSMLSS

SEQ ID NO: 15500 - protein, 1110 aa, Plantago ovata
MDAESTQLAAILGPDPAPFETLISHLMSSANEQRSHAESIFNLLKQKDPNSLSLKLAHLLSTSSSVEARAMAAILLRKQLTHDDSFIWPHLAESTRSTVKSILLQSIQTEETKSIIKKVCDTISELASSLLPENQWPEILPFMFQCVTSNSPKLQESAFLIFSQLAQYIGETLSPYITDLHSVFLNCLNSSTNPDVKIAALSAVINFIQCLSSSNERDRFQDLLPAMMRTLTESLNSGQEATAQEALELLIELAGTEPRFLRRQIVDVVGAMLQIAEAESLEEGTRHLAVEFVITLAEARERAPGMMRKLPQFISRLFANLMKMLLDVEDDPAWHSAEAKDEDAGETSNYSVGQECLDRLAIALGGTTIVPVASEQLPVFLSAPEWQKHHAALIALAQIAEGCAKVMTKNLEQVLSMVLNSFQHPHPRVRWAAINAIGQLSTDLGPDLQVQYHQQVLTALAGAMDDFQNPRVQAHAASVVLNFSENCTPEILTPYLDGIVHKLLLLLQNSKQMVQEGALTALASVADSSQEHFQKYYDAVMPYLKAILVNATDKSNRMLRAKAMECISLVGMAVGKEKFKDDAKQVMEVLMSLQGSQMETDDPTTSYMLQAWARLCKCLGQDFLPYMSVVMPPLLQSAQLKPDVTISSADSDNEIDEDDDSMETITLGDKRIGIKTSVLEEKATACNMLCCYADELKEGFYPWIDQVAPTLVPLLKFYFHEEVRKASVAAMPELLRSAKLAVEKGIAQGRNETYVKQLSDYIVPALVEALHKEPDTEICANMLDALNECIQIAGPILDENQVRSIVDEIKQVITASSSRKTERAERAKAEDFDAEEGELLKEENEQEEEVFDQVGEVLGTLIKTFKASFLPFFDQLSSYLMPMWGKDKTAEERRIAICIFDDVAEQCREAALTYYDTYLPFLLEACNDENPDVRQAAVYGLGVCAEYGGSVFKPLVGEALSRLNVVIGHPNAKQSDNLMAYDNAVSALGKICQFHRDSIDSAQVVPAWLGCLPLKGDLIEAKAVHDQLCSMVERSDREVLGPNNQYLPKIVHVFAEVLCAGNDLATEQTASRMVNLLRQLQQTLPPDTLASTWSSLQPQQQLTLQSILSA

SEQ ID NO: 15501 - protein, 1113 aa, Solanum lycopersicum
MDSESTQQQVAAILGADPAPFETLISHLMSTSNEQRSQAESIFNLIKQNDPNSLAIKLANLLTTSPHIEPRAMSAILLRKLLTRDDDFIWPKLTHSTQSSIKSLLLTCIQHEQSKSIIKKLCDTISELASSILPENQWPEILPFMFHSVTSDSPKLQESAFFIFAQLAQYIGDILVPYTKDLHSVFLQNLNNSSNPDVRIAALSAAINFIQCLAIESQRDRFQDLLPGMMSTLTEALNLGQEATAQEALELMIELAGTEPRFLRRQLVDVVGAMLQIAEAESLEEGTRHLAIEFVITLTEARERAPGMMRKLPQFISRLFAILMKMLLDVEDEVLWHSAEVEHEDAGETSNYSVGQECLDRLAIALGGNTIVPVASEQLPAYLAAPEWQKHHAALIALAQIAEGCSKVMIKNLEQVVNMVLNSFQDPHPRVRWAAINAIGQLSTDLGPDLQVQYHNRVLPALATAMDNFQSPRVQAHAASAVLNFSENCTPEILTPYLDGIVSKLLVLLQNGKQMVQEGALTALASVADSSQEHFQKYYDAVMPYLKTILVNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTISSADSDNELDESDDDSMETITLGDKRIGIKTSVLEEKATACNMLCCYADELKEGFYPWIDQVAPTLVPLLKFYFHEEVRKAAVSAMPELLRSAKLAVEKGIAQGRNETYVKQLSDYIIPALVEALHKEPDTEICASMLDALNECLQISGLLLDEGQVRSIVDEIKQVITASSSRTSERAERAKAEDFDAEEGELLREENEQEEEVFDQVGEILGTLIKTFKAAFLPFFDELSSYLMPMWGKDKTAEERRIAICIFDDVAEQCREAALKYYDTYLPFLLEACNDESPDVRQAAVYGLGVCAEHGGSAFKSLVGEVMSRLYVVLRHPNAIQPENIMAYDNVVSELGKISNFHRDSIDSAQVIPAWLNCLPIKDDLIEAKVVHDQLCSMVERSDRELLGPNNEYLPKVVQIFAEVLCAGRDLVTEQTASRMITLLRQLQQTLPPATLASIWSSLQPQQQLTLQSMLSS

SEQ ID NO: 15502 - protein, 1095 aa, Ricinus communis
MDESAQQLQLQQAQLAAILGQDSAPFETLISSLMSSSNEQRSQAEVLFNLCKQTDPNTLSLKLSHLLQFSPHVDARAMSAVLLRKLLTRDNHVVVDTDSSSYLWPRLSLATQSSIKSILLTSIQHESTKSILKKLCDTVSELAANILPDNGWPELLPFMFNCVSSDSAKLQESAFLIFAQLSQYIGESLIPFIKDLHTVFLQCLGSSPSFDVKIAALNAVINFIQCLTSSADRDRFQDLLPAMMRTLTEALNNGNEATAQEALELLIELAGTEPRFLRRQLVDVVGSMLQIAEAESLEEGTRHLAIEFVITLAEARERAPGMMRKLPQFISRLFAILMRMLLDIEDDPAWHSAENEDEDAGETSNYSVGQECLDRLAISLGGNTIVPVASEQLPAYLAAPEWQKHHAALIALAQIAEGCSKVMIKNLEHVVSMVLNSFHDPHPRVRWAAINAIGQLSTDLGPDLQNQYHQRILPALASAMDDFQNPRVQAHAASAVLNFSENCTPEILTPYLDGIVSKLLVLLQNGKQMVQEGALTALASVADSSQEHFQKYYDAVMPYLKTILVNATDKSNRMLRAKSMECISLVGMAVGKDKFREDAKQVMEVLMSLQGSQMETDDPTTSYMLQPDVTITSADSDNDIDDSDDESMETITLGDKRIGIKTSVLEEKATACNMLCCYADELKEGFFPWIDQVAPTLVPLLKFYFHEEVRKAAVSAMPELLRSAKLAVEKGLSQGRNESYVKQLSDYIIPALVEALHKEPDTEICANMLDALNECLQISGTLVDEGQVRSIVDEIKQVITASSSRKKERADRAKAEDFDAEEGELIKEENEQEEEVFDQVGEILGTLIKTFKASFLPFFDELSTYLTPMWGKDKTAEERRIAICIFDDVAEQCRETALKYYDTYLPFLLEACNDENPDVRQAAVYGLGVCAEFGGSVFKPLVGEALSRLNVVIQHPNAKQSENVMAYDNAVSALGKICQFHRESINSAQIVPAWLNCLPITGDLIEAKVVHEQLCSMVERSDSELLGPNNQYLPKIVSVFAEVLCGKDLATEQTASRMVNLLRHLQQTLPPATLASTWSLLHPQQQMALQSILSS

SEQ ID NO: 15503 - protein, 1116 aa, Mimulus guttatus
MDSVSTQVQQAQLAAVMGPDPAAFENLISNLMSSSNEQRSQAESIFNLLKQNDPNSLALKLAHVLSSSVHLEARAMATILLRKQLTQDDSFIWPKLNESTRFTIKSILLSSIQNEESKSIIKKLCDTISELASSLLPENQWPELLPFMFQCVTSNSPKLQESAFLMLSQLAQFIGEMLIPYITELHNVFLNVLTNSRDPDVRIAALSAVINFIQCLSSSSDRDRFQDLLPSMMSTLTEALNSGQEATAQEALELLIELAGTEPRFLRRQIVDIVGSMLQIAEAETLEEGTRHLAIEFVITLAEARERAPGMMRKLPQFISRLFANLMKMLLDVEDDPDWHSAEDKDEDAGETSNYSVGQECLDRLSIALGGNTIVPVASEQLPAYLSAPEWQKPHATLIALAQIAEGCSKVMIKNLEQVLNMVLSSFQHPHPRVRWAAINAIGQLSTDLGPDLQVQYHQQVLPALASAMDDFQNPRVQAHAASAVLNFSENCTPEILTPYLDGIVHKLLLLLQNSKQMVQEGALTALASVADSSQEHFQKYYDAVMPYLKAILVNATDKSNRMLRAKAMECISLVGMAVGKDKFKEDAKQVMEVLMSLQGAQMETDDPTTSYMLQAWARLCKCLGQDFLPYMNVVMPPLLQSAQLKPDVIITSADSDDELDESDDESMETITLGDKRIGIKTSVLEEKATACNMLCCYADELKEGFYPWIDQVAQTLVPLLKFYFHEEVRKAAVSAMPDLLRSAKLAVEKGIAQGRNETYIKQLSDYIFPALVEALHKEPDTDICANMLDALSECLQISGPLLDESQVRSVVDEIKLVITASSDRKKERAERAKAEDFDAEEGELLKEENEQEEEVFDQVGELLGTLIKTFKASFLPFFDELSSYLMPMWGKDRTAEERRIAICIFDDVAEQCHGAALKYYDTYLPFLLEACNDENPDVRQAAVYGLGVCAEYGGSVFKPLVGESLSRLNFVIRHPNALQPDNVMAYDNAVSALGKICQFHRDSIDSAQVVPAWLSCLPIKGDIIEAKVVHDLLCSMVESSDRELLGPNNQYLPKIVSVFAEVLCSGNDLASQQTFSRMVNLLRQLQQTLPPSTLASTWSSLQPQQQLALQSILSS

SEQ ID NO: 15504 - protein, 1073 aa, Panax ginseng
MDTSQSTQIQQAQLVAILGPDPAPFETLISHLMASSNEQRSQAELIFNLCKQSDPNSLVLKLSHLLQFSPHVEARAMSAILLRKLLTRDDSYIWPRLSPSTQSSLKSFFLSCVQREEAKTIIKKLCDTISELASGILPDNGWPELLPFMFQCVSSDSHKLQESAFLIFAQLSQYIGETLIPHIKHLHTVFLQCLTSSSSSDVRIAALSAVINFIQCLSSSSDRDRFQDLLPAMMRTLTEALNCGQEATAQEALELMIELAGTEPRFLRRQLVEVVGSMLQIAEAETLEEGTRHLAIEFVITLAEARERAPGMMRKLPQFISRLFAILMKMLLDIEDDPAWHLADTEDEDAGETSNYSVGQECLDRLAIALGGNTIVPVASEQLPAYLAAPEWQNHHAALIALAQIAEGCSKVMIKNLEQVVTMVLNSFQDPYARVRWAAINAIGQLSTDLGPDLQVQYHQRVLPALAAAMDDFQSPRVQAHAASAVLNFSENCTPDILTPYLDGIVSKLLVLLENGKQMVQEGALTALASVADSSQEHFQKYYDAVMPYLKAILVNANDKSNRMLRAKAMECISLVGMAVGKEKFRDDAKQVMEVLMSLQGSQMETDDPTTSYMLQAWARLCKCLGQDFLPYMSVVMPPLLQSAQLKPDVIITSADSDNEIDESDDDSMETITLGDKRIGIKTSVLEEKATACNMLCCYADELKEGFYPWIDQVAPTLVPLLKFYFHEEVRKAAVSAMPELLRSAKLAVEKGLAQGRNESYIKQLSDYIIPALVEALHKEPDTEICANMLDALNECVQISGPILDEGQVRSIVDEIKQVITASSSRKKERAERAKAEDFDAEEGELLKEENEQEEEVFDQVGEILGTLIKTFKASFLPFFDEEERRIAICIFDDVAEQCREAALKYYDTYLPFLLEGSNDENSDVRQAAVYGLGVCAEYGGSVFKPLVGEALSRLNVVIRHPNALQPDNVMAYDNAVSALGKICQFHRDSIDSAQVLPAWLSCLPIKGDLIEAKVVHDQLCSMVERSDTELLGPNNQYLSKIVSVFAEVLFAGKDLATEQTASRMINLLRQLQ

SEQ ID NO: 15505 - protein, 987 aa, Trigonella foenum-graecum
LASSILPDNGWPELLPFMFQCVSSDSPKLQESAFLIFAQLSQYIGDSLTPHIKHLHDIFLQCLTSSAVNPDVRIAALNAVINFIQCLSGSADRDRFQDLLPAMMATLTEALNSGQEATAQEALELLIELAGTEPRFLRRQIVDVVGAMLQIAEAESLEEGTRHLAIEFVITLAEARERAPGMMRKMPQFISRLFAILMKMLLDIEDDPQCATPDAEDNDAGESSNYSVGQECLDRLSISLGGNTIVPVASEQLPAYLAAPEWQKRHAALTALAQIAEGSSKVMVKNLEQVVAMVLNSFPDQHPRVRWAAINAIGQLSTDLGPDLQVQYHQGVMPALAAAMDDFQNPRVQAHGASAVLNFSENCTPEILTPYLDGIVSKLLVLLQNGKQMVQEGALTALASVADSSQEHFQKYYDAVIPYLKAILVNATDKSNRMLRAKSMECISLVGMAVGKEKFRADAKQVMEVLMSLQVSQMETDDPTTSYMLQAWARLCKCLGQDFLPYMEFVMPPLLQSASLKPDVTITSADSDNDIDDSDDESMETITLGDKRIGIKTSVLEEKATACNMLCCYADELKEGFFPWIDQVAGTLVPLLKFYFHEEVRKAAVSAMPELLRSAKLAIEKGQSQGRDVSYLKFLTDSIIPALVEALHKEPDTEVCACMLDSLNECLQISGMLLDEKQVRSIVDEVKEVITASSSRKKERAERAQAEDFDAEEGELIKEENEQEEEVFDQVGEILGTLIKTFKASFLPFFEELSSYLTPMWGRDKTPEERRIAICIFDDVAEQCREAAIKYYDTYLPFLLEACNDETPDVRQAAVYGLGVCAEFGGSVFKPLVGEALSRLNAVIQHPNALHSDNVMAYDNAVSALGKICQFHQDSIDSAQVVPAWLNCLPIKGDLIEAKVVHDQLCSMAERSDSSLLGPNNQYLPKIVAVFAEVLCAGKDLATEQTAGRMVSLLRQLQQTLPPATLASTWSSLQPQQQLALQSILSS

SEQ ID NO: 15506 - protein, 1041 aa, Solanum phureja
MSTILLRKLLTRDDSFIWPRLTESTQSGIKSVLLRCIQQEESKSIIKKLCDTISELASSILPENNWPELLPFMFQCVTSDVPKLQESAFLIFALLAQYVGEMLVPYIKDLHTVFMQTLNNSPNPDVRIAGLSAVINFIQCLSSSNDRDRFQDLLPAMMKTLTEALNSGQEATAQEALELLIELAGTEPRFLRRQLVDVVGAMLQIAEAESLEEGTRHLAIEFVITLAEARERAPGMMRKLPQFISRLFAILMKMLLDIDDEPVWHSAEVEHEDAGETSNYSVGQECLDRLSIALGGSTIVPVASEQLPPYLAAPEWQKHHAALIALAQIAEGCTKVMIKNLEQVVNMVLSCFQDPHPRVRWAAINAIGQLSTDLGPDLQVQYHSRVLPALATAMDDFQNPRVQAHAASAVLNFSENCTPEILTPYLDGIVSKLLVLLQNGKQMVQEGALTALASVADSSQEHFQKYYDAVMPYLKTILVNANDKSNRMLRAKAMECISLVGMAVGKDKFRDDAKQVMEVLMSLQGSQMETDDPTTSYMLQAWARLCKCLGQDFLPYMSVVMPPLLLSAQLKPDVTISSADSDNELDDSDDDSMETITLGDKRIGIKTSVLEEKATACNMLCCYADELKEGFYPWIDQVAPTLVPLLKFYFHEEVRKAAVSAMPELLRSAKLAVEKGIAQGRNETYVKQLSDYIIPALVEALHKEPDTEICASMLDALNECVQISGPLLDEGQVRSIVDEIKQVITASSSRKRERAERAKAEDFDAEESELLKEENEQEEEVFDQVGEILGTLIKTFKAVFLPFFDELSSYLMPMWGKDKTAEERRIAICIFDDIAEQCREAALKYYDTYLPFLLEACNDESPDVRQAAVYGLGVCAEYGGSVIKPLVGEALSRLNVVIGHPNALQPENVMAYDNAVSALGKICQFHRDSIDSAQVVPAWLNCLPIKGDLIEAKVVHDQLCSMVERSDVDLLGPNNQYLPKIVSVFAEVLCTGKDLATEQTASRMINLLRQLQQTLPPATLASTWSSLQPQQQIALQSILSS

SEQ ID NO: 15507 - protein, 1085 aa, Flaveria ramosissima
CYYIQRATDRKQSLYSICTNKLIRTRCFFKLGYLLQLSPHMEARAMSAILLRKQLTQDELLVRNRLSPATQSSLKSNLLTCVQQEEAKTIMKKLCDTISELASSLLPDNGWPELVPFMFQCVSSDSVKLQESAFFIFAQLSQYIGESLTPHIKHLHGVFLQCLTTSPSSDVRIAALNAVINFIQCLASGDRDRFQDLLPAMMTTLTEALNGGQEATAQEALELLIELAGTEPRFLRRQLVEVVGSMLQIAEAETLEEGTRHLAIEFVITLAEARERAPGMMRKLPQFISRLFGILLRMLLDVEDEPAWHTAENEDEDAGESSNYCVGQECLDRLAIALGGNTIVPVASEQLPAYLAAPEWQKRHAALISLAQIAEGCSKVMIKNLEQVLSMVLNSFQDPHPRVRWAAINAIGQLATDLGPDLQVQYHQRVLPALATAMDDFNNPRVQAHAASAVLNFSESCTPDILTPYLDGIVSKLLVLLQNGKQMVQEGALTALASVADSSQEHFQKYYDAVIPYLKAILVNANDKANRMLRAKAMECISLVGMAVGKEKFRDDAKQVMEVLMSLQGSQMETDDPTTSYMLQAWARLCKCLGQDFLPYMSVVMPPLLQSAQLKPDVIITSADSDNEIDDSDDESMETITLGDKRIGIKTSVLEEKATACNMLCCYADELKEGFYPWIDQVAPILVPLLKFYFHEEVRKAAVSAMPELLRSAKLAIEKGLAQGRNESYIKQLSDYIVPALVEALHKEPDTEICASMLVALNECIQVSGPLLDENQVRSIVDEIKQVITASSSRKTERAERAKAEDFDAEEGELLKEENEQEEEVFDGISEILGTLIKTFKASFLPFFDEMSSYLMPMWGKDKTAEERRIAICIFDDVAEQCREAALKYYDTYLPFLLEACNDENPDVRQAAVYGLGVCAEYGGSVIKPLVGEALSRLNVVIRHPNALQPENVMAYDNAISALAKICQFHRDSINTTQIISAWLSCLPIKGDLIEAKVVHELLCSMVERSDMELLGPNNQNVPKIVSVFAEILCGGKDLATEQTINRIINPLRQLQQTLPPATFASTWASLQPQQQLAIQSVLTS

SEQ ID NO: 15508 - protein, 1018 aa, Gossypium hirsutum
VSTHSSIKSVLLNQIQVETAQSLSKKLCDTVSELASSILPENGWPELLPFMFQCVSSDSPRLQESAFLIFAQLSQYIGDVLTPFIKDLHTVFLKCLSGNSNADVKIAALNAVINFIQCLTSSSDRDRFQDLLPAMMKTLTEALNNGNEATAQEALELLIELAEMEPRFLRRQIVDVVGSMLQIAEAESLEEGTRHLAIEFVVTLAEARERAPGMMRKLPQFISRLFAILMRLLLDIEDDAAWHTAEVEDEDAGETSNYAVGQECLDRLAISLGGNTIVPVASEQFSTYLAAPEWQKHHAALIALAQIAEGCSKVMVKNLEQVVSMVLNSFNHSHPRVRWAAINAIGQLSTDLGPDLQNQYHQRVLPALAAAMDDFQNPRVQAHAASAVLNFSENCTPEILTPYLDGIVSKLLVLLQNGKQMVQEGALTALASVADSSQEHFQKYYDAVMPYLKAILVNATDKSNRMLRAKSMECISLVGMAVGKEKFRDDAKQVMEVLMSLQGSQMETDDPTTSYMLQAWARLCKCLGQDFLPYMSVVMPPLLQSAQLKPDVTITSADSDNDIEDSDDESMETITLGDKRIGIKTSVLEEKATACNMLCCYADELKEGFFPWIDQVAPTLVPLLKFYFHEEVRKAAVSAMPELLRSAKLAVEKGMAQGRNETYVKQLSDYVIPALVEALHKEPDTEICASMLDALNECVQISGPLLDESQVRSIVDEIKQVITASASRKSERAERAKAEDFDAEEGELIKEENEQEEEVFDQVGEILGTLIKTFKASFLPFFDELSSYLTPMWGKDKTPEERRIAICIFDDVAEQCREAALKYYDTYLPFILEACNDENPDVRQAAVYGLGVCAEFGGPVFKPLVGEALSRLNAVIRHPNASQPENVMAYDNAVSALGKICLFHRDSIDATQVVPAWLNCLPIKGDLIEAKVVHEQLCSMVERSDNEVLGPNHNFLPKIVSVFAEVLCGKDLATEQTASRMVNLLRQLQQTLPPAALASTLSSLQPQQQLALQSILSS

SEQ ID NO: 15509 - protein, 1068 aa, Nicotiana benthamiana
MNSESTQYQQAQLAAILGADPAPFETLISHLMSTSNEQRSQAESIFNLIKQNDPNSLSLKLANLLTSSPHIKPRAMSAILLRKLLTRDDSFIWPKLTESTRSSIKSVLLTCIQREESKSIIKKLCDTVSELASSILRENQWPELLPFMFQCVTGDSPKLQESAFLIFAKLAQYIGEILVPYIKDLHSVFLQTLNNSPNPDVRIAALSAVINFIQCLSSSSERDRFQDLLPAMMKTLTEALNSGQEATAQEALELLIELAGTEPRYLRRQLVDVVAAMLQVAEAESLEEGTRHLAIEFVITLAESRERAPGMMRKLPQFISRLFAILMKMLLDVEDEAVWHSAEAEHEDAGETSNYSVGQECLDRLAIALGGNTIVPVASEQLPSYLAAPEWQKHHGALIALAQIAEGCSKVMIKNLEQVVNMVLNSFQDPHPRVRWAAINAIGQLSTDLGPDLQVQYHSRVLPALAAAMDDFQNPRIQAHSASAVLNFSENCTPEILTPYLDGIVSKLLVLLQNGNQMVQEGALTALASVADSSQEHFQKYYDAVMPYLKTILVNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTISSADSDNELDDSDDDSMETITLGDKRIGIKTSVLEEKATACNMLCCYADELKEGFYPWIDQVAPTLVPLLKFYFHEEVRKAAVSAMPELLRSAKLAVEKGIAQGRNESYVKQLSDYIVPALVQALHKEPDTEICASMLDALNECLQISGPLLDEGQVRSIVDEIKQVITASSSRKRERAERAKAEDFDAEESELLREENEQEEEVFDQVGEILGTLIKTFKAAFLPFFDELSSYLMPMWGKDKTAEERRIAICIFDDVAEQCHEAALKYYDTYLPFLLEACNDESPDVRQAAVYGLGVCAEYGGSVFKSLVGEALSRLNVVLRHPNALHSENVMAYDNAVSALGKICNFHRDSIDSAQVIPAWLNSLPIKGDLIEAKVVHDQLCSMVERYWTVCCNLYPVHRLWIKDVNQFVGGVKL

SEQ ID NO: 15510 - protein, 977 aa, Panax ginseng
QRSQAEVIFNLCKQTDPNSLVLKLAQLLQFSPHVEARAMSAILLRKQLTRDDSYIWPRLSPSTQSSLKSIFLACVQREEAKTIIKKLCDTVSELASGILPDNGWTELLPFMFQCVSSDSHKLQESAFLIFAQLSQYIGETLIPHIKHLHTVFLQCLTTSSSSDVRIAALSAVINFIQCLSSSSDRDRFQDLLPAMMSTLTEALNCGQEPTAQEALELMIELAGTEPRFLRRQLVEVVGSMLQIAEAETLEEGTRHLAIEFVITLAEARERAPGMMRKLPQFISRLFAILMKMLLDVEDDPAWHTADTEDEDAGETSNYSVGQECLDRLAIALGGNTIVPVASEQLPAYLAAPEWQKHHAALIALAQIAEGCSKVMIKNLEQVVTMVLNSFQDPHARVRWAAINAIGQLSTDLGPDLQVQYHQRVLPALAAAMDDFPNPRVQAHAASAVLNFSENCTPDILTPYLDGIVSKLLVLLQNGKQMVQEGALTALASVADSSQEHFQKYYDAVMPYLKAILVNANDKSNRMLRAKAMECISLVGMAVGKDKFRDDAKQVMEVLMSLQGSQMETDDPTTSYMLQAWARLCKCLGQDFLPYMSVVMPPLLQSAQLKPDVIITSADSDNEIDESDDESMETITLGDKRIGIKTSVLEEKATACNMLCCYADELKEGFYPWIDQVAPTLVPLLKFYFHEEVRKAAVSAMPELLRSAKLAVEKGLAQGRNESYIKQLSDYIIPALVEALHKEPDTEICASMLDALNECVQISGPILDESQVRSIVDEIKQVITASSSRKRERTERAKAEDFDAEEGELLKEENEQEEEVFDQVGEILGTLIKTFKASFLPFFDELSSYLMPMWGKDKTAEERRIAICIFDDVAEQCHEAALKYYDTYLPFLLEACNDESPDVRQAAVYGLGICAEYGSSVFKPLVGEALSRLNVVIRHPNALQPENVMACDNAVSALGKYANFIETVLIQLRFFLPG

SEQ ID NO: 15511 - protein, 1024 aa, Echinacea purpurea
MDPQLQQAQLAAILGADPAPFETLISHLMSSSNEQRSNAELLFNLCKQTDPNTLFLKLGHMLQGSPHMEARAMSAVLLRKQLTQDDSLIWNRLSPATHSSLKSILLSCVQREEAKTIMKKLCDTISELASTILPDNGWPELLPFMFQCVSSDSPKLQESAFLIFAQLSQSQYVGASLIPHIKHLHDVFLQCLTTSGSADVRIAALSAVINFIQCLSSSGDRDRFQDLLPAMMRTLTESLNGGQEATAQEALELLIELAGTEPRFLRRQLVEVVGSMLQIAEAETLEEGTRHLAIEFVITLAEARERAPGMMRKLPQFISRLFGILLRMLLDIEDEPAWHTAENEDEDAGESSNYSVGQECLDRLAIALGGNTIVPVASEQLPAYLAAPEWQKHHAALIALAQIAEGCSKVMIKNLEQVVSMVLNSFQDPHPRVRWAAINAIGQLATDLGPDLQVQYHQRVLPALASAMDDFNNPRVQAHAASAVLNFSENCTPDILAPYLDGIVSKLLVLLQNGKQMVQEGALTALASVADSSQEQFQKYYDAVMPYLKTILVSANDKANRMLRAKAMECISLVGMAVGKEKFRDDAKQVMEVLMSLQGSQMETDDPTTSYMLQAWARLCKCLGQDFLPYMSVVMPPLLQSAQLKPDVVITSAESDNEIDESDDESMETITLGDKRIGIKTSVLEEKATACNMLCCYADELKEGFYPWIDQVAPTLVPLLKFYFHEEVRKAAVSAMPELLRSAKLAIEKGLAQGRNESYIKQLSDYIVPSLVEALHKEPDTEICASMLDALNECIQVSGPLLDENQVKSIVDEIKQVITASSSRKTERAERAKAEDFDAEEGELLKEENEQEEEVFDQVGEILGTLIKTFKVSFLPFFDEMSSYLMPMWGKDKTAEERRIAICIFDDVAEQCREAALKYYDTYLPFLLEACNDENPDVRQAAVYGLGVCAEYGGSAIKPLVGEALSRLNVVIRHPNALQPENVMAYDNAVSALGKICQFHRDSIDSAQIVPAWLSCLPIKGDLI

SEQ ID NO: 15512 - protein, 123 aa, Glycine max
MAYLRFSHAAPQPHLTLGFPSPPQFLSIAAPKFSPSSSTIRCKGFSRLIVNQRLVTVFATNPNSVGEKSPTEGSDVNETSNAAQGPPLLTILAGFFVLFVVCWSIWSIITWLISLIVNVPAPK

SEQ ID NO: 15513 - protein, 710 aa, Glycine max
MSRVSANSSPSRLVSMASIVRAYTLPILLFAGAMFYQLFLIPNAFPPSHYDVLQIESYSSVEKVKEAYDKLESKWNSAVEVFDIHEFLKIRYAYELLTNPLWKRDYDIFGIDEQLHIVESASKRYAGKHISELDFPLLQAPSGSIDHSSKVITASDFQYIFPDAKPWLIQLYSSGSERCAQFSKSWNKIASLLDVFANIGMVELGEKELAIYLADRRSTGKPFFRNGIPSLVAIPAGCRSSKCIIRFDGELTVDTVTNWFATTVLALPQINYYSRESLVPNFLGKTSLHKVKVIFFSNSGERAAPFIRQAAKDYWASASFAFILWREEESSYWWGAFGVESAPAIVFLKDPGVKPVVHHGSVNNSFFLNLMENNKQQELPQLRSVTSMELGCDPHGYSRAGYDTVTWYCAIAVGRPSLELNKMRETMCRVQETLSKHSQVDASSENQSLAPAVDAFKRRRLTFAWLDGEKQKDYCQFYLGQAASEHTCGQRRGVTDIPRLFVIRYLRNSSAVDLRTEEKTKWKSLLVQDLINDSDQTGQFVAGYKGEDDVSQITHWLANIISDGDSRDLPFFTLRTPKLVPDDTEPIWSMSAQNIPLQNLKQSVLGVLSGLSAYREDPRVGPFLLLGALISLGTIWLRRSQQVQSPELNQPSFNQPSDSNQPSQPSSMDERKQKPSDRVRRRPNKKPPPSMTDLEPSDAYQMPLSDSESE

SEQ ID NO: 15514 - protein, 631 aa, Glycine max
MAASKLTSCVAVTSAAVVSMSAFSDRAYADSYFRLPFFSSKPSNEPSPPNQTSDSKSEPPPPDEPNKSGGFDPESLERGAKALREINSSPYSKQLFDLMRKQEETRLAELDAEKVHYELIQSQGDIERQRKMAEEQRNLIQDQAQRQAQVLRYEDELARKRMQTDHEAQRQHNVELVKMQEQSSFRKEQARQATEEQIQSQQRQTERERAEIERETIRVKAMAEAEGRAHEAKLTEDHNRRMLIERMQGERDKWLAAINTTFSHIEGGLRALLTDRDKLLMTVGGATALAAGIYTTREGSKVTWGYINRILGQPSLIRESSMAKFPGSEIISQAKNKVLCNSTLAGAEKPIGSKNGLGNVILHPSLQRRIEHLARATSNTKSHQAPFRNMLFYGPPGTGKTMVAKELARRSGLHYAMMTGGDVAPLGAQAVTKIHDIFDWAKKSRKGLLLFIDEADAFLCERNSSHMSEAQRSALNALLFRTGDQSRDIVLVLATNRPGDLDSAVTDRIDEVIEFPLPGEEERLKLLKLYLNKYLCDDNNGSKGGFFLKKQPQKITIKDLSEDVFREAAKKTEGFSGREIAKLMASVQAAVYGRPDCILDAQLFREIVDYKVVEHHQRLKLAAEGGQPCQI

SEQ ID NO: 15515 - protein, 632 aa, Cajanus cajan
MAASRLTSCVAVTSAAVLSMSTFSDRASADSSFRFPFFSSSPSNAPPPPPPSQASDGKSEPPPPDEPNKSGFDPESLERGAKALRQINSSPYAKQVFDLMRKQEETRLAEIDAEKVHYELIQSQGDIERQRKMAEEQRNLIQEQAQRQAQVMRYEDELARKRMQTDHEAQRRHNVELVKMQEQSSVRKEQARQATEEQIQSQQRQTERERAEIERETIRVKAMAEAEGRAHEAKLTEDHNRRMLIERMQGERDKWLAAINTTFSHIEGGVRALLTDRDKLLMTVGGATALAAGVYTTREGAKVTWGYINRILGQPSLIRESSMAKFPGSKIISQAKNKVLNNSSLAGAEKPIGSRNGLGNVILHPSLKRRIEHLARATSNTKSHQAPFRNMLFYGPPGTGKTMVAREIARRSGLDYAMMTGGDVAPLGAQAVTKIHEIFDWAKKSRKGLLLFIDEADAFLCERNSSHMSEAQRSALNALLFRTGDQSRDIVLVLATNRPGDLDSAVIDRIDEVIEFPLPGEEERLKLLKLYLNKYLRDDNDGSKGGFLLKKQPQRITIKDLPEDVFREAARKTEGFSGREIAKLMASVQAAVYGRPDCILDSQLFKEIVDYKVVEHHQRLKLAAEGGQPGQV

SEQ ID NO: 15516 - protein, 626 aa, Glycine max
MAASRLTSCVAVTSAAVVSMSTFSDRAYADSYFRLPFFSSKSSSEPSPPNQPSDSNSEPPPPDEPNKSGFDPESLERGAKALREINSSPYSKQLFDLMRKQEETRLAELDAEKVHYELIQSQGDIERQRKMAEEQRNLIQDQAQRQAQVLRYEDELARKRLQTDHEAQRQHNVELVKMQEQSSFRKEQARQATEEQIQSQQRQTERERAEIERETIRVKAMAEAEGRAHEAKLTEDHNRRMLIERMQGERDKWLAAINTTFSHIEGGLRALLTDRDKLLMTVGGATALAAGIYMTREGSKVTWGYINRILGQPSLIRESSMAKFPGSKIISQAKNKVLHDSTLAGAEKPIGSKNGLGNVILHPSLQRRIEHLARATSNTKSHQAPFRNMLFYGSPGTGKTMVAREIARRSGLDYAMMTGGDVAPLGAQAVTKIHDIFDWSKKSRKGLLLFIDEADAFLCERNSSHMSEAQRSALNALLFRTGDQSRDIVLVLATNRPGDLDSAVTDRIDEVIEFPLPGEEERLKLLKLYLNKYLCDDNNGSKGGFFLKKQPQKISIKDLSEDVFREAATKTEGFSGREIAKLMASVQAAVYGRPDCILDSQLFRESIDYKVVEHHQRLKLAADGQI

SEQ ID NO: 15517 - protein, 628 aa, Cicer arietinum
MAAARLTSCVAVTAAAVASISTSSDRAYAESYFRFPFFSSSPSGSPSSTDPASDSKSESPPPEDSKKSGFDPESLERGAKALREINNSTHAKKVFDLMHKQEKTRLAELEAEKVYYELIQAQGDIDRLRKVIEEQRNLEQEKAQRQAQVLRYEDELARKRMQTVHEDQRRHNVELVKMQEESSVRKEQARQATEEQIQSQKRQTERERAEIERETIRVKKMAEAEARAHEAKLTEDHNRRMLIERMQGERDKWLAAINTTFSHIEGGLRVLLTDRDKLLMTVGGATALAAGVYTTREGAKVTWGYINRILGQPSLIRESSMAKFPGARIMSLAKNKLSNYSTLARAEKPAGSQNGLGNVILHPSLQRRIQHLARATSNTKAHQAPFRNMLFYGPPGTGKTMVAREIARKSGLDYAMMTGGDVAPLGPQAVTKIHEIFDWAKKSRRGLLLFIDEADAFLCERNSSHMSEAQRSALNALLFRTGDQSRDIVLVLATNRPGDLDSAITDRIDEVIEFPLPGEEERLKLLNLYLNKYLCDETNGSKGGLFLKKQAQKITIKDLSEDVLREAAKKIEGFSGREIAKLVASIQAAVYGRPDCTLDSQLFKEIVDYKVVEHHQRIKLAAEGVLPA

SEQ ID NO: 15518 - protein, 627 aa, Lupinus angustifolius
MVSAKLSSCVAVAAAAVASVSPPSDTAHAAGFRIPFFSSSPSPSAPDQASDNKTDPTPSDEPNKSGFDPESLERAAKALRKINSSPYAKQVFDVMRKQEQTRLAELDAEKIHYELIQSQQDIDRTRKIAEEQRNLIQEQAQRQAQVQRYEDELARKRMQTDHEAQRHHNVELVKLQEESSVRKEQARRATEEQVQSQQRQTERERAEIERETIRVKAMAEAEARAHEAKLTEDHKRRMLFERMQGERDKWLAAINTTFSHIEGGLRVLLTDRDKLIMTVGGATALAAGVYTTREGAKVTWGYINRILGQPSLIRESSMAKFPGSRIVSEATNKILNYSSSSRVDTSVLNQNGLGNVILHPLLKKRIEHLARATSNTKAHQAPFRNMLFYGPPGTGKTMVAREIARKSGLDYAMMTGGDVAPLGPQAVTKIHDIFDWAKKSRKGLLLFIDEADAFLCERNSIHMSEAQRSALNALLFRTGDQSRDIVLVLATNRPGDLDSAITDRIDEAIEFPLPGEEERLKLLKLYLDKYLHDDNSSSKGVFLLKKQPQKITIKDISEDVLGEAAKQTEGFSGREIAKLMASVQAAVYGRPDCILDSQLLKEIVDYKVVEHHQRLKLAADGGLPDPM

SEQ ID NO: 15519 - protein, 630 aa, Lotus japonicus
MTAARLTSCVVATTAAAAASYSARSDRAYADSRFRFPFFSSSPPSNSPSSSDQASDTKSETPPPDESSKSGFDSPELLERAARALRKINNSRLAKEVFAIMRAQEKTRLAELDAEKVHYELIQAHNDIERQRKIVEEQRNLLQDQAQREAQARRQEDDLARKRMQADHEVQRQNNVELVKRQEESAVRKERSRQATEEQIQSQQRQTEKERAEMERETIRVKAMAEAEGRAHEAKLTEDQKRRMLVDRIQGERDKWLAAINTTFSHIEGGLRVLLTDRDRLLMTVGGVTALAAGVYTTREGAKVTWGYINRILGQPSLIRESSMAKFPGARIVSQAKNKVYSTLGGAEKPIGSQNGLGNVILHPSLLKRIQHLARATSNTKAHQAPFRNMLFYGPPGTGKTMVAREIARRSGLDYAMMTGGDVAPLGAQAVTKIHEIFDWAKKSRKGLLLFIDEADAFLCERNSTYMSEAQRSALNALLFRTGDQSRDIVLVLATNRPGDLDSAVTDRIDEVIEFPLPGEEERLKLLKLYLNKYLCHDNNGSKGGLLLKKQPKQITIKDLSEDVLKEAAKKTEGFSGREIAKLMASVQAAVYGRPDCVLDSQLLKEIVDYKVVEHHQRLQLASEGGIFSF

SEQ ID NO: 15520 - protein, 169 aa, Glycine max
MAARAKTPLNTLSSFTFTLFLSFSLLQLSLSSPTTIHDLLRSKGLPPGLLPEEVKSYTFSETGHLEVFLDAPCLTKYENRVLFEQVVTANLTYGSLIGVEGLQQEELFVWLPVKDIIVNDPSSGLILFDIGLAHKQLSLSLFEDPPHCKNQGGLRNHVRKEKGFFEALR

SEQ ID NO: 15521 - protein, 166 aa, Vigna unguiculata
MAQKTENEETEFKVPETITLCVNNCGVTGNPATNNMCQNCFTAFTASTATTSSATAATAGVSSLSARSAASARPQKRSFPEEPSSAADPPSSDQNTPSEAKRVVNRCSGCRRKVGLTGFRCRCGELFCAEHRYSDRHDCSYDYKAAGREAIARENPVVRAAKIVKV

SEQ ID NO: 15522 - protein, 164 aa, Glycine max
MAQKTEKEETDFKVPETITLCVNNCGVTGNPATNNMCQKCFTAFTTSTATTSGAGGAGIASPATRSGISARPLKRSFPEEPSPPADPPSSDQTTPSEAKRVVNRCSGCRRKVGLTGFRCRCGELFCAEHRYSDRHDCSYDYKAAGREAIARENPVIRAAKIVKV

SEQ ID NO: 15523 - protein, 161 aa, Glycine max
MAQKTEKEETDFKVPETITLCVNNCGVTGNPATNNMCQKCFTASTATTSGAGGAGIASPATRSGVSARPQKRSFPEEPSPVADPPSSDQTTPSEAKRVVNRCSGCRRKVGLTGFRCRCGELFCAEHRYSDRHDCSYDYKAAGREAIARENPVIRAAKIVKV

SEQ ID NO: 15524 - protein, 160 aa, Cajanus cajan
MAHKTEKEETDFKVPETITLCVNNCGVTGNPATNNMCQNCFAAFTASTSATSATSAAAGARSGASARPQKRSFPDEAATAADPPCSEQTTPSEAKRVVNRCSGCRRKVGLTGFRCRCGELFCAEHRYSDRHDCSYDYKAAGREAIARENPVIRAAKIVKV

SEQ ID NO: 15525 - protein, 158 aa, Glycyrrhiza uralensis
MAQKTEKEETDFKVPETITPCINNCGVTGNPAMNNMCQKCFTASTATTSSAGISTPSSRSAARSSKRSFPEEEETVQAADPPASEQTTPSEAKRVVSRCSGCRRKVGLTGFRCRCGELFCAEHRYSDRHDCTYDYKAAGREAIAKENPVIRAAKIVKV

SEQ ID NO: 15526 - protein, 250 aa, Glycine max
MALLIHSLEMSVAPQISQNPNPKLSKLHSFKPYPKGKAIGSTRGVRISCKVKDCVVLDENVNSYGQFSVPVKQGSKQSKEEEEEKQNYYVNVGYAIRTLREEFPDLFYKELSFDIYRDDIVFKDPMNTFIGIENYKSIFWALRFHGMMFFKALWVEISSVWQPVENVIMVRWTVHGIPRVLWESRGRFDGTSEYKLDKQGKIFEHRVDNIAMNSPPRFKVLGVEELIRSIGCPSIARPTYFEISSPPKRT

SEQ ID NO: 15527 - protein, 247 aa, Glycine max
MALLIHSLEMSVTPQIAPNPNLKLRKFNSFKPHTKGKAIGSTRGVRIFCKVKDCAVLDENVNSYGQFSVPVKQGSKQSKEEEEEKQNYYVNVGYAIRTLREEFPDLFYRELSFDIYRDDIVFKDPMNTFIGIENYKSIFWALRFHGRMFFKALWVEISSVWQPVENIIMVRWTVHGIPRVLWESRGRFDGTSEYKLDKQGKIFEHRVDNIAMNSPPRFKVLGVEELIRSIGCPSTARPTYFEISSPP

SEQ ID NO: 15528 - protein, 246 aa, Cajanus cajan
MALLIHSPEVSVAPQIAHNPNPNLPKLHSFRPHTKAKAIGPKRGVRISCKVKDFAVVNPYGQFSVPVKRGSKQSKEEEEEKQNYYVNVGYAIRSLREEFPDLFYRELSFDIYRDDIVFKDPMNTFVGIENYKSIFWALRFHGKMFFKALWVDISTVWQPVENVIMVRWTVHGIPRVLWESRGRFDGTSEYKLDRQGKIFEHRVDNIALNSPPRFKVLGVEELIQSLGCPSTARPTYFEISSPPKRM

SEQ ID NO: 15529 - protein, 389 aa, Cajanus cajan
METSAAMDVEEQPSPNPTNVKCFGLKNSIQTNFGDDYVFQIVPKDDWSAMAVSLSTNAVKLYSPVAGQYYGECKGHSATINQISFSGPSNPHVLCSCSSDGTIRAWDTRTFQQVSSIIAGSSQEVFSFCLGGTSGNLVAAGCKSQILFWDWRNMKQIACLEDSHVDDVTQVHFVPNDQGKLISASEDGLICTFDTAGDINDDDHLESVINMGTSIAKVGIFGENYQKLWCLTHIETLGIWNWKDGRNEGNFSDARTLASESWNLDHVDYFIDCQYSREADKLWVIGGTNAGTMGYFPVNYEGVATIGAAEAILEGGHTSVIRSILPMSKFHSGPTNSPSQGIFGWTGGEDGRLCCWLSDDSSESNQSWISSTLVMKPERTRKKNRHHPY

SEQ ID NO: 15530 - protein, 389 aa, Glycine max
METSAAMDVEEQPSPNASDVKRFGLKNSIQTNFGDDYVFQIVPNDDWSAMAVSLSTNAVKLYSPVAGQYYGECKGHSETINQILFSGPSNPHVLCSCSSDGTIRAWDIRTFQQVSSINAGPSQEVFSFCIGGTGGNLVAAGCKSQILFWDWRNMKQVACLEDSHVDDVTQVHFVPNEQGKLISASVDGLICTFDATGDINDDDHLESVINMGTSIAKVGIFGENYQKLWCLTHIETLGIWNWKDGRNEGNFSDARTIASESWNLDHVDYFIDCHYSREAEKLWVIGGTNTGTMGYFPVNYEGVATIGAAEAILEGGHASVIRSVLPMSTIPSGPTNSPSQGIFGWSGGEDGRLCCWLSDDSSESNQSWISSTLTMKPERTCKKHRHHPY

SEQ ID NO: 15531 - protein, 389 aa, Glycine max
METSAAMDVEDQPSPNSNNVKRFGLKNSIQTNFGDDYVFQIVPKEDWSAMAVSLSTNAVKLYSPVAGQYFGEFKGHSETVNQISFSGPSNPHILCSCSSDGTIRAWDARTFQQVSSINAGPSQEVFSFCMGGTSGNLVAAGCKSQVLFWDWRNMKQVACLVDSHVDDVTQVHFVPNERGKLISASVDGLICTFDTTGDINDDDHLESVINMGTSIAKVGIFGETFQKLWCLTHIETLGIWNWKDGSNEGNFLDARTLASESWNLDHVDYFIDCHYSREAEKLWVIGGTNAGTMGYFPVNYKGVATIGAAEAILEGGHTSVIRSVLPMSTIPSGPTNSPSQGIFGWTGGEDGRLCCWLSDDSSESNQSWISSTLTMKAERTHKKNRHHPY

SEQ ID NO: 15532 - protein, 378 aa, Medicago truncatula
MDVEEQRPFPIPNNVKRFGLKNSIQTNFGDDYVFQIIPKDDWSSMAVSLSTNAVKLYSPVMGQYYGECKGHTATINQILFSGHSNPNILSSCSSDGTIRTWDTRTFQQVSIINAGPSQEIFSFSIGGPSGNLVAAGCDSQVLLWDWRNNKQIACLEDSHVDDVTQVHFIPEERGKLISASVDGLVCIFDTTGDINDDDHLESVINVGTSIAKVGFFGESYQKLWCLTHIETLGIWDWKEGRNEVNFSDTRTLASESWNLDHVDYFVDCHYSREAEKLWLIGGTNAGTLGFFPVNYSETTTIGGAEAILEGGHTDVVRSVLPMSRVHSSGIFGWTGGEDGRLCCWLSDDDSPQKNQSWISSSLVMKPERTCKKNRHHPY

SEQ ID NO: 15533 - protein, 392 aa, Lupinus angustifolius
METSAAMDIEEQPSPNNNNNNLKRFGLKNSIQTNFGDDYVFQIIPKDDWSSMAVSLSTNTVKLYSPEKGQYYGECKGHYATINQIMFSDASNSHVLSSCSSDGTIRAWDTRTFQQVSSINAGPSQEVFSFSFGGPGGNLIAAGCKSQILFWDWRNKKQIACLEESHVDDVTQVHFVHEEQSKLISTSVDGLICTFDTTGDINDDDHLESVINVGTSIAKVGIFGDNCQKLWCLTHIETLGIWDWKNGTNEVNFSDARGLASESWNLDQVDYFVDCHYSKEAEKLWVIGGTNAGALGYFPVNDKGQATIGGAEAILEGGHTDVVRSVLPMSRFHGGSAPSSVSSGIFGWTGGEDGRLCCWLSDDSTQINQSWIASSMIMKPEKTRKKKRHHPY

SEQ ID NO: 15534 - protein, 382 aa, Lupinus angustifolius
MDVEEQPSPNNLKRFGLKNSIQTNFGDDYVFQIISKDDWSSMAVSLSTNTVKLYSPERGEYYGECKGHHATINQILFSDASNAHVLSSCSSDGTIRAWDTRTFQQVSSISAGPSQEVFSFSFGGPGGNLIAAGCKSQILFWDLRNRKQIACLEESHVDDVTQVHFVHEEQGKLISASVDGLICTFDTTGDINDEDHLESVINVGTSIAKVGIFGDNYQRLWCLTHIETLGIWDWKNGRNEVNFSDARGLASESWNLDQVDYFVDCHYSKEAEKLWLIGGTNAGALGYFPVNHKGVATIGGAEAILEGGHTGVVRSVLPMSRFHGAPAPISGSSGIFGWTGGEDGRLCCWLSDDSPQINRSWISSTLVMKPEKTGKKNRHHPY

SEQ ID NO: 15535 - protein, 410 aa, Glycine max
MALLGLMSFAALTLFLVLTTVPRQAHASSRGNLGRNINPSVYGICASSVIVHGYKCQEHEVTTDDGYILSLQRIPEGRGKSSGSGTRKQPVVIQHGVLVDGMTWLLNPPEQDLPLILADNGFDVWIANTRGTRYSRRHISLDPSSQAYWNWSWDELVSYDFPAVFNYVFSQTGQKINYVGHSLGTLVALASFSEGKLVNQLKSAALLSPIAYLSHMNTALGVVAAKSFVGEITTLFGLAEFNPKGLAVDAFLKSLCAHPGIDCYDLLTALTGKNCCLNSSTVDLFLMNEPQSTSTKNMVHLAQTVRLGALTKFNYVRPDYNIMHYGEIFPPIYNLSNIPHDLPLFISYGGRDALSDVRDVENLLDKLKFHDENKRSVQFIQEYAHADYIMGFNAKDLVYNAVLSFFNHQV

SEQ ID NO: 15536 - protein, 392 aa, Cajanus cajan
MKHTLQTVAPLGRNIVIPPSFGICASSVIVHGYKCQEHEVTTNDGYILSLQRIPEGRGGGGGASGTRKQPVIIQHGVLVDGMTWLLNPPEQDLPLILADNGFDVWIANTRGTRYSRRHISLDPSSPAFWNWSWDELVSYDLPAVFDYVFSQTGHKINYVGHSLGTLIALASFSEGKLVNQLKSAALLSPIAYLSHMHTALGVIAARSFIGEITTLFGLAEFNPKGLPVEAFLKSLCNHPGIDCYNLLTALTGKNCCLNSSTVDLFLMNEPQSTSTKNMVHLAQTVRHGVLAKFNYVRPDYNIMHYGEIFPPIYNLSNIPHDLPLFISYGGRDALSDVRDVENLLDILKNHDEDKRSVQFIQEYAHADYIMGFNAKDLVYNDVVSFFNRQVNA

SEQ ID NO: 15537 - protein, 305 aa, Vigna unguiculata
MSFSVAASLGTHIALRNTHEARIKCHFLYRREENSKIGFKFSKHKAVQRKISLSKQDFSELDERKSPDEVREEIKKCYELINRLGRGAVYLGSSRMGPSHSHYVQAQELAKEIANLLDCTTWSGAGPGLMDAVTQGAMLAGKPVGGFKIGKEAGEWTASNFHAYLPSENYLTCRFFSARKHGLVDAVVRNNSFDKTAVVTLPGGIGTLDELFEMLALIQLERIGSKLPVPLLLMNYDSFYSKLLDFLNDCEGWGTVSKGEVASLWKVCNSNSEALAYLEEFYGISSIDISKKVIQFHSTYGSPSS

SEQ ID NO: 15538 - protein, 305 aa, Glycine max
MGFSVAASLGTYVVLRDTHETRIKCQFLCRKEQNSRIGFKFSKHKAIQSAIFFSKHEFTDLDERKSSDEVKEEIKKCYELINRLGRGVVYLGSSRMGPSHSHYVQAQELAKEIANLLDCTSWSGAGPGLMDAVTQGSMLAGKPVGGFKIGREAGEWTASNFHPYLPSENYLTFRFFSARKHGLVDAVVRNNSFDKTAVVALPGGIGTLDEVFEILALIQLERIGSKFPVPFLLMNYDSFYSKLLEFLNDCEGWGTVSKGEVASLWKVCNSNSEALAYLEEFYGISSSDKSKNVTKLYSTYESPSS

SEQ ID NO: 15539 - protein, 304 aa, Cajanus cajan
MGFSVAASLGTHVVLRDTHQTKFKCQFLCGTEQNNRIGFEFSKHKGIHRAIFVSKQEFTELDERKSPDEVKEEIKKCYELINRLGRGALYLGSSRLGPSHAHYVQAQGLAKEIANLLDCTSWSGAGPGLMDAVTQGGMLAGKPVGGFKIGKEAGEWTASNFHPYLPSENYLTCRFFSARKHGLVDAVVRNNSFDKTAVVALPGGIGTLDEMFEILALIQLERIGSELPVPFLLMNYDSFYSKLLDFLNDCENWGTVSRGEVASLWKICNSNSEALAYLADFYGISSSDRKNVTKLCSTHESPSS

SEQ ID NO: 15540 - protein, 249 aa, Glycine max
MLTFNLNAISSSFSVVPFHANYPLSTQTQLLVPSNLSYSFATTGTRKFKSFQLKAGFWESIKSGLMKNNSMQVIDPPSADEEDEEPLPQEFVLVEKTEPDGTIEQIIFSSGGDVDVYDLQALCDKVGWPRRPLSKLAAALKNSYIVASLHSIRKSPGSEGNEQKRLIGMARATSDHAFNATIWDVLVDPGYQGQGLGKALIEKLIRTLLQRDIGNITLFADSQVVEFYRNLGFEADPEGIKGMFWYPNH

SEQ ID NO: 15541 - protein, 160 aa, Cajanus cajan
MLTLNLNAISSSFSVVPFHANYPLSTQTQLLVPSNLNYSFATTATRKFKSFQLKAGFWESIKSGLKKNNTTQVIDPPSTDEEDEEPLPQEFVLVEKTEPDGTIEQIIFSSGGDIDVYDLQALCDKVGWPRRPLSKLAAALKNSYIVASLHSIRKSPGSVI

SEQ ID NO: 15542 - protein, 255 aa, Glycine max
MLTFSIDYYLYMCLCCFRFSVVQFHANYPLSTQTQLLVPSNLNYSFATTATRKFKSFQLKAGFWESIKSGLMKNNSMQVIDPPSTDEENVEPLSQDFVLVEKTEPDGTIEQIIFSSGGDVDVYDLQALCDKVGWPRRPLSKLAAALKNSYIVASLHSIRKSHGSEGNEQKRLIGMARATSDHAFNATIWDVLVDPGYQGQGLGKALIEKLIRTLLQRDIGNITLFADSQVVEFYRNLGFEADPEGIKGMFWYPNH

SEQ ID NO: 15543 - protein, 246 aa, Cicer arietinum
MLTLNLNPLSSSFSIHANYPLFTQIQLLAPTNLNYPFANTATRKFRTFQLKAGFWDSIKSGLMKNNTTQVIDPQSAEEEDEEPLPQEFVLVEKTESDGTIEQIIFSSGGDIDVYDLQALCDKVGWPRRPLSKLAAALKNSYIVASLYSIRKSPGSEGNEQKRLIGMARATSDHAFNATIWDVLVDPGYQGQGLGKALVEKLIRTLLQRDIGNITLFADSKVVEFYRNLGFEADPEGIKGMFWYPTH

SEQ ID NO: 15544 - protein, 249 aa, Glycine max
YLVPLFFLCLLLVLIITYTCVYVVSGSQLFNFMPIIHCLLKLNSTRKFKSFQLKAGFWESIKSGLMKNNSMQVIDPPSTDEENVEPLSQDFVLVEKTEPDGTIEQIIFSSGGDVDVYDLQALCDKVGWPRRPLSKLAAALKNSYIVASLHSIRKSHGSEGNEQKRLIGMARATSDHAFNATIWDVLVDPGYQGQGLGKALIEKLIRTLLQRDIGNITLFADSQVVEFYRNLGFEADPEGIKGMFWYPNH

SEQ ID NO: 15545 - protein, 621 aa, Glycine max
MSPANLEEECLKLLKGERDEQRLAGLLLVTKFCKAEDQSSVRRVYDAVGPHFLYRLLRTGMASGGGGLNDNRNAYLSLSITVLATFCRVPDIASSEDMLFYIPLVLEVISTGSVLSVLEECYEFLYLVSAASESGIARFFESGGIKILASQMRSLHDGSHLMELSFKLLQLILGRTSSDIIQNNDLSEISVIVAAIARQFAVLHNSLKFEALHLLNAILSSKDSSQLRDAFRLLPQDSWSPNIRIGIMAILQNRVAPAERLQALILAESMVSMYGEDWLIGQVSTNDALDPAPADMCLLLVLEQSRVEIAVLLNELAYLKYEAPQDTSATAEAIFSKRHNVAVAYSLVERIIKLISNVEGNDGNLLDEGTLTKLIHQLNETIAVVLEYLEDAKEHGQKKGDDLLASVRIIGSYLAEAPVACKEKVQDLLGYMLSLEGEDEQRPFYAVCFLLPMLSQITMEIEGCKALASCKGLEAVLDCFSKLVGSHAFLVEDNGCIFMACDTIMNLLLKKDKVQIKLDVSAIVDLLKVLAHWSENTDEMSSMMMASSICTLIFDYTSEEALLNCPDFDYRTLSSLYLLIARCLASSEQDTKVDMDLSEIVSSGFSRWAHRYPHIRDAVKN

SEQ ID NO: 15546 - protein, 618 aa, Cajanus cajan
MKGTQSPNLEDCLKLLKGERDEQRLAGLLLVTKFCKADDHASLRRVYDAVGPRFLYRLLRTGMGSGTNDNRDAYLSLSITVLAVFCRVPEIASTEDMVLNIPLVLEAISTQSGLSVLEECYEFLYLVSAASGDGITRFCESGGMKMLASQMCSMEDGSHLMELSFKLLQLILSRKSLDIIQNDVLSEISVIVAAIARQFAVLHNSLKFEALHLLNAILSSKDSSQLRDAFRLLPQDSWSSNIRIGIMAILQNRVAPAERLQALILAESMVSMYGEHWLVSQVSKNDAKNPAPADMCLLLVLEQSRVEIAVLLNELAYLKYEAPQDTSATAEAIFSKQHNVAVAFSLVEKIIKLISNVDDGNPLDEGTLTKLILQLNETIAVVLEYLEDAKEHRQNKGDDLLASVRIIGSYLAEAPVACKEKVQDLLGYMLSVEGEDEQRPFSAVCFLLPMLCQITMEIEGCKTLASCKGLEAVSDCFSKLVGSHAFLVEDNGCIFLACDTIMNLLLKKDKVQIMLDELAIVGLLKTLAYWSENTDEMSCLMMASSICALIFDYTSEEALLNRPDFNYRTLSSLYKLIGRCLASSEQDSKADMDLSEIISSGFSRWAHRYPHIREAVKN

SEQ ID NO: 15547 - protein, 616 aa, Glycine max
MEEEWLKLVKGERDEQRLAGLLLVTKFCKAEDQSSVRRVYDALGPHFLYRLLRTAMASGGGGLNDNRNAYLSLSITLLAAFCRVPDIASSEDMLFHIPLVLEVISTRSVLSVLEECYEFLYLVSAASESGFARFFESGGIKMLASQMRSLQDGSHLMELSFKLLQLILGRTSSDIIQNNDLSEISVIVAALARQFAVLHNSLKFEALHLLNAILSSKDSSQLRDAFRLLPQDSWSPNIRIGIMAILQNRVAPAERLQALILAESMVSMYGEDWLIGQVSTNDALDPAPADMCLLLVLEQSRVEIAVLLNELAYLKYEAPLDTSATAEAIFLKRHNVADAYSLVERIIKLISNVEGNDGNLLDEGTLTKLIHQLNETIAVVLEYLEDAKEHGQKKGDDLLASVRIIGSYLAEAPVACKEKVQDLLGYMLSLEGEDEQRPFYAVCFLLPMLSQITMEIEGCKALASCKGLEAVLDCFSKLVGSHAFLVEDNGCIFMACDTIMNLLLKKDKVQIMLDVSAIVDLLKALAHWSENTDEMSSMMMASSICTLIFDYTSEEALLNCPDFDYRTLSSLYLLIARCLASSEQDTKAYMDLSEIVSSGFSRWAHRYPHIRDAVKN

SEQ ID NO: 15548 - protein, 1162 aa, Cajanus cajan
MAASGERWIDRLQFSSLFWPPPPDEQQRKDQIAAYVEYIGQFTSEQFPDDIAELIRNRYPSKEMLLFDDVLAVLVLHHPEHGHAVVLPIISCIIDGTLVYDKTSPPFASFISLVCPKSENEYSEQWALACGEILRILTHYNRPIYKNERQYCEAEGSSGKSPATTKGSVDGESGHNSLMQQEKKPIRPLSPWITDILLAAPLGIRSDYFRWCSGVMGKYAAGELKPPTIVSARGSGKHPQLMPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYACGIRLPRNWIHFHFLRAIGTAMSLRSGVAADAAAALLFRILSQPALLFPPLRQVDGVEVQHEPLGGYISSNRKQIETAATEATIDATAQGIASMLCAHGSEVEWRICTIWEAAYGLIPLNSSAVDLPEIVVATPLQPPILSWNLYIPLLKVLEYLPRGSPSEACLMKIFVATVEAILQRTFPVSDQKRNPRYYCVGSASKNLAVAELRTMVHSLFLESCASVELASRLLFVVLTVCVSHEVQFNGSKKPRGEDSYSVEEITEDLQAVTKSQKKTKNRKMKKQGPVAAFDSYVLAAVCALACELQLFPVVSRGDNQAVPNNVQNIAKPVKIDVSSHELQNGIDSAIRHTRRILSILEALFSLKPSSVGTSWSYSSNEIVAAAMVAAHISELFRRSKACMRALSVLMHCKWDNEIHFRASSLYNLIDIHSKAVASIVNKAEPLGATLIHTPICKDPCGSCKRQNQCENNSCLDSGQRSISTSEDSPPSELSQKCKRTSYSNEPSRFSFAKVATSLLFDASDLANFLTNDRHIGFNCSAQIFLRSRLTEKQELCFSVVSLLWQKLIASPETQPCAESTSAQQGWRQVVDALCKVVSASPVKAATAIVLQAEKELQPWITKDDSLSQKMWRINQRITKLIIELMRNHDSLESLVIVASASDLLLRATDGMLVDGEACTLPQLKLLEATAKAVQPVIELGESGFAVADSLSNLLKCRLPATIRCLSHPSAHVRALSTSVLRDIWQTSSIRSSPKPQQKNGTHNQYFNLDLIDQQTHIEKCLTWEAHSRLSNGLSIEYLNTAAKDLGFSISI

SEQ ID NO: 15549 - protein, 296 aa, Vigna unguiculata
MIDLSTLNPAQITVLGSAFCVMLSMHFTSQLLSQHLFYWKNPKEQKAIIIIILMAPLYATVSFVGLLDIRGSKEFFTFLESVKECYEALVIAKFLALMYSYLNISISGNTVPDEIKGREIHHSFPMTLFQPRIVHLNYRNLKLLKYWTWQFVVIRPVCSILMIALQLLGLYPTWLSWTFTAILNVSVSLALYSLVVFYHVFAKELAPHTPLAKFLCIKGIVFFCFWQGMLLDLLAKFGVIQSRHLRLDVEHIEEAMQNILVCVEMVIFSVLQQYAYHPAPYSGEVEKMLRQNKKND

SEQ ID NO: 15550 - protein, 296 aa, Glycine max
MIDISTLNAAQITVLGSAFCAMLSMHFTSQLLSQHLFYWKNPKEQKAIIIIILMAPIYAAVSFVGLLDIRGSKEFFTFLESVKECYEALVIAKFLALMYSYLNISISRNIVPDEIKGREIHHSFPMTLFQPRTVRLNHHNLKLLKYWTWQFVVVRPVCSVLMIALQLVGLYPTWLSWAFTIVLNISVSLALYSLVVFYHVFAKELAPHKPLAKFLCIKGIVFFCFWQGMLLELLAATGVIQSRHLRLDVEHIEEAMQNILVCLEMVIFSVLQQYAYHPAPYSGEVEKMLKQNKKNE

SEQ ID NO: 15551 - protein, 296 aa, Cajanus cajan
MIDLSTLNPAQLTVLGSAFCVMLSMHFTTQLLSQHLFYWKNPKEQKAIIIIILMAPLYAAVSFVGLLDIRGSKEFFTFLESVKECYEALVIAKFLALMYSYLNISISGNIVPDEIKGREIHHSFPMTLFQPRTVRLNHRTLKLLKYWTWQFVVIRPVCSILMIAFQLLGLYPTWLSWTFTIILNISVSLALYSLVVFYHLFAKELAPHKPLSKFLCIKGIVFFCFWQGMLLDLLASFGIIKSRHLRLDVEHIEEAMQNILVCLEMVIFSVLQQYAYHVAPYSGEVEQMLKQSKKYE

SEQ ID NO: 15552 - protein, 296 aa, Glycine max
MIDISTLNAAQITVLGSAFCVMLSMHFTTQLMSQHLFYWKNPKEQKAIIIIILMAPIYAAVSFVGLLDIRGSKEFFTFLESVKECYEALVIAKFLALMYSYLNISISRNIVPDEIKGREIHHSFPMTLFQPCTVRLNHHNLKLLKYWTWQFVVVRPVCSFLMIALQLLGLYPTWLSWAFTIVLNISVSLALYSLVVFYHVFAKELAPHKPLAKFLCIKGIVFFCFWQGMLLDLLAAIGVIQSRHLRLDVEHIEEAMQNILVCLEMVIFSVLQQYAYHPAPYSGEVEKMLKQNKKNE

SEQ ID NO: 15553 - protein, 296 aa, Glycine max
MIDISTLNAAQITVLGSAFCVMLSMHFTTQLMSQHLFYWKNPKEQKAIIIIILMAPIYAAVSFVGLLDIRGSKEFFTFLESVKECYEALVIAKFLALMYSYLNISISRNIVPDEIKGREIHHSFPMTLFQPCTVRLNHHNLKLLKYWTWQFVVVRPVCSFLMIALQLLGLYPTWLSWAFTIVLNTSVSLALYSLVVFYHVFAKELAPHKPLAKFLCIKGIVFFCFWQGMLLDLLAAIGVIQSRHLRLDVEHIEEAMQNILVCLEMVIFSVLQQYAYHPAPYSGEVEKMLKQNKKNE

SEQ ID NO: 15554 - protein, 295 aa, Arachis hypogaea
MDFRNLNPAQITMMGSGFCVMLSMHFTTQLLSQHLFYWKNPKEQKAIIIIILMAPIYAVVSFVGLLDIRGSKEFFTFLESIKECYEALVIAKFLSLMYSYLNISISRNIVPDEIKGREIHHSFPMTLFQPHTVRLNHHTLKLLKYWTWQFVVIRPVCSVLMILLQAVGLYPNWLSWGFTIILNISVSLALYSLVVFYHVFAKELEPHKPLAKFLCIKGIVFFCFWQGMLLDILGGMGVLKPRHLKLDVEHVEEAMQNILVCIEMVIFSVLQQYAYHVHPYSGQVEQMLKQNKKNE

SEQ ID NO: 15555 - protein, 181 aa, Vigna unguiculata
MATNNSEVYHERQRLQFCLVHSLNSLFQQKDAFTRAKLNEISERLALQDSNTETWTPFSFIFKPHHNVITGNYDVNVLIAALEEKGKSVEWHDRRKGASCIDLDAPVLMGIVVNVSASRFGGIWRSRHWIALRKINGVWFNLDSDLDAPQPFLDAHEVREFLDFTLAQRGEVLIVLNEKQS

SEQ ID NO: 15556 - protein, 183 aa, Cajanus cajan
MATKNSQIYHERQKLQFCLLHSLNSLFQQKDAFTRAKLNAISERLALEDSDTETRTPLSVLFKPHHNVLTGNYDINVLIAALEEKGKSVVWHDRRNGASSIDLDASEDVLMGIVINVSVTRFAGIWRSRHWIALRKIEGVWYNLDSDLVAPKPFLDTEKVREFLDFTLAHGGEVLIVMNEKQS

SEQ ID NO: 15557 - protein, 354 aa, Glycine max
MATENSQVYHERQRLQFCLVHALNSLFQQKDAFTRAKLNAISERLTLEDSNSETWTPLSVLFKPHHNVLTGNYDINVLIAALEEKGKTVVWHDRRKGASSIDVDAPEDVLMGFVINVAVTRFAGIWRSRHWIALRKIDGVWYNLDSDLTAPQPFFDTDKVREFLDSTLAHGGEVLIVMNEKHSHLSNNSASNFPSFTYNSFQLSITSHTTVSHIAFSHEYNAIIIQARISNKMSQSGYMNEKPGLSLRQNSNRKSTRNGQVKSCMFRIPWQSETSPIELVKDLAERVTNALRLISPKRFLHRGSSSLTRSKSAGSSVDSHRTAAVEDCIEFIHSSFSRSNSSTAAPRQDSIQAP

SEQ ID NO: 15558 - protein, 183 aa, Glycine max
MATENSQVYHERQRLQFCLVHALNSLFQQKDAFTRAKLNAISERLTLEDSNSETWTPLSVLFKPHHNVLTGNYDINVLIAALEEKGKTVVWHDRRKGASSIDVDAPEDVLMGFVINVAVTRFAGIWRSRHWIALRKIDGVWYNLDSDLTAPQPFFDTDKVREFLDSTLAHGGEVLIVMNEKQS

SEQ ID NO: 15559 - protein, 183 aa, Glycine max
MATENSQVYHERQRLQFCLVHSLNSLFQQKDAFTRAKLNAISERLALEDSNSETWTPLSVLFKPHHNVLTGNYDINVLIAALEEKGKSVLWHDHRKGASSIDVDAPEDVLMGVVINVALKRFAGIWRSRHWIALRKIDGVWYNLDSDLAAPQPFLDTYKVREFLDSTLVHGGEVLIVMNEKQS

SEQ ID NO: 15560 - protein, 444 aa, Glycine max
MPFPGRGHINPMMNLCKILASKRPNEILITFVVTEEWLGFIGAEPKPDAVRLAAIPNVVPPERLKAANFPAFYEAVVTEMQAPFERLLDRLQPPPTAILGCVELRWPIAVANRRNIPVAAFWTMSASFYSMLHHLDVFARHRGLTVDKDTMDGQAENIPGISSAHLADLRTVLHENDQRVMQLALECISKVPRANYLLLTTVQELEAETIESLKAIFPFPVYPIGPAIPYLELGQNPLNNDHSHDYIKWLDSQPPESVLYISFGSFLSVSTTQMDQIVEALNSSEVRYLWVARANASFLKEKCGDKGMVVPWCDQLKVLSHSSVGGFWSHCGWNSTLEALFAGVPMLTFPLFLDQVPNSSQIVDEWKNGSKVETSKLDSEVIVAKEKIEELVKRFMDLQSQEGKEIRDRAREIKVMCLRAIAAGGSSYGNLDAFIRDISKPLTH

SEQ ID NO: 15561 - protein, 195 aa, Vigna unguiculata
NILKKRSKEVLIYSITESRKISNIFSAFIIFLGSLGLLLVAISSYLGMGLFLFSQEISNFPFIPQGAAMAFYGIGGLFISFYLWWIILWDIGGGFDIFDKKNKEEVCFLRWGFPGKNRRIILKIPMNEIKSIRIITGVQERSILTRTLTYESLVYMETIEQGFIPLTRIEDNLTPLEIANRAGELSFFLGVPLLY

SEQ ID NO: 15562 - protein, 521 aa, Glycine max
MADQKNQNPDSGTISVESAKEKRRNKLPNFLLSVRLKYVKLGYHYVISNAMYLLLIPLLGIASAHLSTLSIKDFLQLWENLKFNLVSVTLCSSLTVFLATLYFMTRPRGVYLVDFACYKPDVDCTCTREIFVERSGLTGSFSEENLSFQKKILERSGLGQKTYLPPAILSLPPRPCMAAAREEAEQVMFGAIDQLLAKTGVKAKDIGILVVNCSLFNPTPSLSAMIVNHYKLRGNVFSYNLGGMGCSAGLISIDLAKHLLQVHPNSYALVVSMENITLNWYFGNNRSMLVSNCLFRMGGAAILLSNRSGDRHRAKYQLVHTVRTHKGADDKSYGCVFQEEDETKRIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIKKGDRTWQIAFGSGFKCNSAVWRALRTINPAKEKNPWMDEIHEFPVHVPKVAPIAS

SEQ ID NO: 15563 - protein, 517 aa, Glycine max
MADRKNSGSIRVESAQEKRRKKLPNFVVSVRLKYVKLGYHYVISNAMYLLLIPLLGIASAHLSTISMKELVRLWENLKFDLVSVTLCSSLMVFLGTLYFMSRPRGVYLVDFACYKPDVDCKCTREIFVERSGLTGSFSEENLSFQKKILERSGLGQKTYLPPAILSLPPKPCMAAAREEAEKVMFGAIDQLLAKTGVKAKDIGILVVNCSLFNPTPSLSAMIVNHYKLRGNVFSYNLAGMGCSASLISIDLAKHLLQVHPNSYALVVSMENITLNWYFGNNRSMLVSNCLFRMGGAAILLSNRSGDRRRAKYQLVHTVRTHKGADDKSYSCVFQEEDETKRIGVALSKDLMAVAGEALKTNITTLGPLVLPMSEQLLFFATLVARKVFKMKIKPYIPDFKLAFEHFCIHAGGRAVLDELEKNLELSDWHMEPSRMTLYRFGNTSSSSLWYELAYTEAKGRIKKGDRTWQIAFGSGFKCNSAVWRALRTINPAKENNPWMDEIHDFPVHVPKVAPIAS

SEQ ID NO: 15564 - protein, 517 aa, Glycine max
MADRKNSGSIRVESAQEKRRKKLPNFVVSVRLKYVKLGYHYVISNAMYLMLIPLIGTASAHLSTISMKELVRLWENLKFDLVSVTLCSSLMVFLGTLYFMSRPRGVYLVDFACYKPDVDCKCTREIFVERSGLTGSFTEENLSFQKKILERSGLGQKTYLPPAILSLPPKPCMAAAREEAEQVMFGAIDQLLAKTGVKAKDIGILVVNCSLFNPTPSLSAMIVNHYKLRGNVFSYNLAGMGCSASLISIDLAKHLLQVHPNSYALVVSMENITLNWYFGNNRSMLVSNCLFRMGGAAILLSNRSGDRRRAKYQLVHTVRTHKGADDKSYSCVFQEEDETKRIGVALSKDLMAVAGEALKTNITTLGPLVLPMSEQLLFFATLVARKVFKMKIKPYIPDFKLAFEHFCIHAGGRAVLDELEKNLELSDWHMEPSRMTLYRFGNTSSSSLWYELAYTEAKGRIKKGDRTWQIAFGSGFKCNSAVWRALRTINPAKENNPWMDEIHDFPVHVPKVAPIAS

SEQ ID NO: 15565 - protein, 518 aa, Cajanus cajan
MADEKNHENHDSPANERRNNKLPNFLLSVKLKYVKLGYHYVISNAMYLMLIPLLGIASAHLSTLSIKDFVQLWENLKFNLVLVTACSGLIVFIATLYFMTRPRGVYLVDFACYKPHDDCKVTREVFIEKSGLTGSFSEENLSFQKRVLERSGLGQNTYLPPAILSLPPKPCMAAARKEAEEVMFGAIDQLLAKTRVKAKDIGILVVNCSLFNPTPSLSAMVVNHYKLRGNILSYNLGGMGCSAGLISIDLAKQLLQVHPNSYALVVSMENITLNWYFGNNRSMLVSNCLFRMGGAAILLSNRSSDRGRAKYQLVHTVRTHKGADDRSYGCVFQEEDETKRIGVALSKDLMAVAGEALKTNITTLGPLVLPMSEQLLFFATLVARKVFKMNIKPYIPDFKLAFEHFCIHAGGRAVLDELEKNLDLSEWHMEPSRMTLNRFGNTSSSSLWYELAYTESKGRIKKGDRTWQIAFGSGFKCNSAVWRAMRTINPAQEKNPWTDEIHQFPVHVPKVAPIASKS

SEQ ID NO: 15566 - protein, 518 aa, Cajanus cajan
MADEKNHENHDSPANERRNNKLPNFLLSVKLKYVKLGYHYVISNAMYLMLIPLLGIASAHLSTLSIKDFVQLWENLKFNLVLVTACSGLIVFIATLYFMTRPRGVYLVDFACYKPHDDCKVTREVFIEKSGLTGSFSEENLSFQKRVLERSGLGQNTYLPPAILSLPPKPCMAAARKEAEEVMFGAIDQLLAKTRVKAKDIGILVVNCSLFNPTPSLSAMVVNHYKLRGNILSYNLGGMGCSAGLISIDLAKQLMQVHPNSYALVVSMENITLNWYFGNNRSMLVSNCLFRMGGAAILLSNRSSDRGRAKYQLVHTVRTHKGADDRSYGCVFQEEDETKRIGVALSKDLMAVAGEALKTNITTLGPLVLPMSEQLLFFATLVARKVFKMNIKPYIPDFKLAFEHFCIHAGGRAVLDELEKNLDLSEWHMEPSRMTLNRFGNTSSSSLWYELAYTESKGRIKKGDRTWQIAFGSGFKCNSAVWRAMRTINPAQEKNPWTDEIHQFPVHVPKVAPIASKS

SEQ ID NO: 15567 - protein, 517 aa, Glycine max
MADHTPGSGTVSVEASSQERRKLPNFLLSVRLKYVKLGYHYLISNAMYLLLIPLLGVASAHLSTISYQDVVQLWENLKFNLVSVTLCSSLIVFLVTFYFMSRPRGVYLVDFACYKPEPDCTCTREIFMHRSVETGVFSEENLAFQKKILERSGLGQKTYLPPAILSIPPNPCMAEARKEAEQVMFGAIDQLLEKTGVKAKDIGILVVNCSLFNPTPSLSAMIVNHYKLRGNIQSYNLGGMGCSAGLISIDLAKQLLQVHPNSYALVVSMENITLNWYFGNNRSMLVSNCLFRMGGAAVLLSNKSSDRRRAKYQLIHTVRTHKGADDRSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWRALRTINPAKEKNPWMDEIHEFPVHVPKVATISS

SEQ ID NO: 15568 - protein, 516 aa, Phaseolus vulgaris
MADQTRDSGNVSVEASEERRKLPNFLLSVRLKYVKLGYHYLISNAMYLLLIPLIGVASAHLSTLSYQDVAQLWENLKFNLVSVTVCSSLIVFLVTFYFMSRPRGVYLVDFACYKPEQDCNCTRETFMDRSIKTGVFSEENLSFQKKIIERSGLGQKTCLPTSILSVPPNPCMAEARKEAEQVMFGAIDQLLAKTGVKANDIGILVVNCSLFNPTPSLSAMIVNHYKLRGNIQSYNLGGMGCSAGLISIDLAKQLLQVHPNSYALVVSMENITLNWYFGNNRSMLVSNCLFRMGGAAVLLSNRSSDRRRAKYQLIHTVRTHKGADDKSYGCVFQEEDESKNIGVSLSKDLMAVAGEALKTNITTLGPLVLPMSEQLLFFATLVARKVLKTKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWRALRTINPAKEKNPWMDEIHEFPVHVPKVATIGS

SEQ ID NO: 15569 - protein, 517 aa, Glycine max
MADQTPGSGTVSVEASSQERRKLPNFLLSVRLKYVKLGYHYLISNAMYLLLIPLLGVASAYLSTISYQDVVQLWENLKFNLLSVTLCSSLIVFLVTFYFMSRPRGVYLVDFACYKPEPECTCTREIFMNRSVETGVFSEENLAFQKKILERSGLGQKTYLPPAILSVPSNPCMAEARKEAEQVMFGAIDQLLEKTGVKAKDIGILVVNCSLFNPTPSLSAMIVNHYKLRGNIQSYNLGGMGCSAGLISIDLAKQLLQVHPNSYALVVSMENITLNWYFGNNRSMLVSNCLFRMGGAAVLLSNKSSDRRRAKYQLIHTVRTHKGADDKSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWRALRTINPAKEKNPWMDEIHEFPVHVPKVATIGS

SEQ ID NO: 15570 - protein, 518 aa, Lupinus angustifolius
MENNKNQNLDSGTISVESQQGKRKLPNFLLSVRLKYVKLGYHILISNAMYLLLIPILGVASAHLSTTSINDVIQLWENLKFNLVSVTLCSSLIVFLATLYFMSRPRGVYLVDFACYKPEENCICTRETFMDRSVLTGTFSDENLAFQKKILERSGLGQKTYLPPAILRVPPNPNMAEARKEAEEVMFGAIDQLLAKTGVKAKDIGVLVVNCSLFNPTPSLSAMIVNHYKLRGNIQSYNLGGMGCSAGLLSIDLAKQLLQVHPNSYALVVSMENITLNWYFGNNRSMLVSNCLFRMGGAAILLSNKSSDRKKAKYQLVHTVRTHKGADNKSYGCVFQEEDDKKTVGVALSKDLMAVAGEALKTNITTLGPLVLPMSEQLLFFATLVARKVLKMKIKPYIPDFKLAFEHFCIHAGGRAVLDELEKNLDLSDWHMEPSRMTLYRFGNTSSSSLWYELAYTEAKGRIRKGDRTWQIAFGSGFKCNSAVWRALRTIDPAKEKNPWMDEIHEFPVHVPKVETIN

SEQ ID NO: 15571 - protein, 519 aa, Lupinus angustifolius
MANNKNQQNLDSGTISFESPQGKRKLPNFLLSVRLKYVKLGYHILISNAMYLLLIPFLGLASAHLSTISINDVVQLWENLKFNLVSVTLCSSLIVFLATLYFMSRPRGVYLVDFACYKPEENCICTREIFMDRSRLTGTFSDENLAFQKKILERSGLGQKTYLPPAILRVPPNPNMAEARKEAEEVMFGAIDQLLAKTGVNAKDIGILVVNCSLFNPTPSLSAMIVNHYKLRGNIQSYNLGGMGCSAGLLSIDLTKQLLQVHPNSYALVVSMENITLNWYFGNNRSMLVSNCLFRMGGAAILLSNKSSDRRRAKYQLVHTVRTHKGADNKSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWHALRTIDPAKEKNPWMDEIHEFPVHVPKVATID

SEQ ID NO: 15572 - protein, 516 aa, Cajanus cajan
MADQTHDSGSVSVGTSQEGRKLPNFLLSVRLKYVKLGYHCLISNAMYLMLIPLIGLASAHLSTISYQDVVQLWESLKFNLVWVTLCVSLIVFLATFYFMSRPRGIYLVDFACYKPEPNCTCTRETFMDRSVNAGAFSEENLAFQKRIIERSGLGQKTYLPSAILSVPANPCMAEARKEAEQVMFGAIDQLLQKTGVKAKDIGILVVNCSLFNPTPSLSAMIVNHYKLRGNILSYNLGGMGCSAGLIAVDLAKQLLQVHPNSYALVVSMENITLNWYFGNNRSMLVSNCLFRMGGAAVLLSNRPSDRRRAKYQLIHTVRTHKGADDKCYGCVFQEEDEQKSIGVALSKDLMAVAGEALKTNITTLGPLVLPMSEQLLFFATLVARKVLKMKIKPYIPDFKLAFEHFCIHAGGRAVLDELEKNLELTDWHMEPSRMTLNRFGNTSSSSLWYELAYTEAKGRIKKGDRTWQIAFGSGFKCNSAVWRALRTINPAKEKNPWMDEIHEFPVHVPKVATISS

SEQ ID NO: 15573 - protein, 519 aa, Lupinus angustifolius
MANNMNQTLDSSETISFESPKEKMKLPNFLLSVRLKYVKLGYHILISNAMYLLLIPLLGLASAHLSTISINDVVQLWENLKFNLLSVTLCSSLIVFLATLYFMSRPRGVYLVDFACYKPQENCICTREIFMERSELTETFSDENLAFQKKILERSGLGQKTYLPPAILRVPPNPNMAEARKEAEEVMFGAIDQLLEKTGVKAKDIGILVVNCSLFNPTPSLSAMIVNHYKLRGNIQSYNLGGMGCSAGLLSIDLAKQLLQVHPNSYALVVSMENITLNWYFGNNRSMLVSNCLFRMGGAAILLSNKSCDQRRAKYQLLNTVRTHKGADNKSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLDLSDWHMEPSRMTLNRFGNTSSSSLWYELAYTEAKGRIRKGDRTWQIAFGSGFKCNSAVWRALRTIDPAKEKNPWMDEIHDFPVHVPKVATIS

SEQ ID NO: 15574 - protein, 623 aa, Vitis vinifera
MGERGKNKLPNFLLSVRLKYVKLGYHYLISHGMYLLLVPLLGVAAAHLSTLTIKDFLQLWNHLKFNLVTVILCSALMVFLATLYFMSRPRKVYLVDFACYKPEKARMCTREIFMERSVLTGTFSEENLAFQKKILERSGLGQNTYLPEAVLRVPPNPCMAEARKEAELVMFGAIDQLLAKTGVKAKDIGILVVNCSLFNPTPSLSAMIVNHYKLRGNIMSYNLGGMGCSAGLISIDLAKQMLQVHPNSYALVVSMENITLNWYFGNNRSMLVSNCLFRMGGAAILLSNRSSDRRRSKYQLIHTVRTHKGADDRCYNCVFQEEDETKTIGVALSKDLMAVAGEALKTNITTLGPLVLPMSEQLLFFLTLVGRKIFKMKIKPYIPDFKLAFEHFCIHAGGRAVLDELEKNLDLSEWHMEPSRMTLYRFGNTSSSSLWYELAYTEAKGRIRKGDRTWQIAFGSGFKCNSAVWRAIRTIDPVKEKNPWMDEIDEFPVHVPKVASIVMKTTQNCTNCVHSDLTMMKISSFCSVVKPIFPFLPLIGFSKILGILFSLLPVQENAFSVSCFVSFVDGRKRRQKLEDDTSVLQLAFGDLSRKGLHIQLSKLSKFGSLYRIFKKKFIFVYKM

SEQ ID NO: 15575 - protein, 521 aa, Vitis vinifera
MGDEKESLGTSGCVLVQDMGERGKNKLPNFLLSVRLKYVKLGYHYLISHGMYLLLVPLLGVAAAHLSTLTIKDFLQLWNHLKFNLVTVILCSALMVFLATLYFMSRPRKVYLVDFACYKPEKARMCTREIFMERSVLTGTFSEENLAFQKKILERSGLGQNTYLPEAVLRVPPNPCMAEARKEAELVMFGAIDQLLAKTGVKAKDIGILVVNCSLFNPTPSLSAMIVNHYKLRGNIMSYNLGGMGCSAGLISIDLAKQMLQVHPNSYALVVSMENITLNWYFGNNRSMLVSNCLFRMGGAAILLSNRSSDRRRSKYQLIHTVRTHKGADDRCYNCVFQEEDETKTIGVALSKDLMAVAGEALKTNITTLGPLVLPMSEQLLFFLTLVGRKIFKMKIKPYIPDFKLAFEHFCIHAGGRAVLDELEKNLDLSEWHMEPSRMTLYRFGNTSSSSLWYELAYTEAKGRIRKGDRTWQIAFGSGFKCNSAVWRAIRTIDPVKEKNPWMDEIDEFPVHVPKVASIVT

SEQ ID NO: 15576 - protein, 438 aa, Vitis vinifera
MGDEKESLGTSGCVLVQDMGERGKNKLPNFLLSVRLKYVKLGYHYLISHGMYLLLVPLLGVAAAHLSTLTIKDFLQLWNHLKFNLVTVILCSALMVFLATLYFMSRPRKVYLVDFACYKPEKARMCTREIFMERSVLTGTFSEENLAFQKKILERSGLGQNTYLPEAVLRVPPNPCMAEARKEAELVMFGAIDQLLAKTGVKAKDIGILVVNCSLFNPTPSLSAMIVNHYKLRGNIMSYNLGGMGCSAGLISIDLAKQMLQVHPNSYALVVSMENITLNWYFGNNRSMLVSNCLFRMGGAAILLSNRSSDRRRSKYQLIHTVRTHKGADDRCYNCVFQEEDETKTIGVALSKDLMAVAGEALKTNITTLGPLVLPMSEQLLFFLTLVGRKIFKMKIKPYIPDFKLAFEHFCIHAGGRAVLDELEKNLDSVSGIWSLQG

SEQ ID NO: 15577 - protein, 204 aa, Tripterygium wilfordii
MAGENRQNPRPESSEGRANKLPNFLLSVRLKYVKLGYHYLISNAMYLLLLPLLLISSAHLSTFTLKNFMQLWIHLKFNFVSATLCSGLIVFLATLFFTSRPRKVYLVDFSCYKPPAERICTKEAFMERSTLAGSFTEENLAFQKKILERSGLGQKTYLPEAVLQTPTKSVYGRRQEKKQRPLCSMQSTNSCRKQGLRLKILGFL

SEQ ID NO: 15578 - protein, 524 aa, Theobroma cacao
MAAESRQSSNAEPVRFQAASSEERRSNNLPNFLLSVRLKYVKLGYHYLISNAMYLMLVPLLGIAAAHLSTLTFLDFVQLWDQLKFNLVSVTLCSGLLVFLATLYFMSRPRKVYLVDFACYKPEADRTCTREIFMERSGLTGSFTEENLAFQKKILERSGLGQKTYLPEAVLHVPPNPCMAEARKEAETVMFGAIDELLAKTGVKAKDIGILVVNCSLFNPTPSLSAMVVNRYKLRGNILSYNLGGMGCSAGLISIDLAKQLLQVHPNSYALVVSMENITLNWYFGNDRSMLVSNCLFRMGGAAILLSNRFSDRRRSKYQLIHTVRTHKGADDKCYNCVFQREDDTKRIGVSLSKDLMAVAGEALKTNITTLGPLVLPMSEQLLFFVTLVARKVFKMKIKPYIPDFKLAFEHFCIHAGGRAVLDELEKNLDLTDWHMEPSRMTLYRFGNTSSSSLWYELAYSEAKGRIRKGDRTWQIAFGSGFKCNSAVWKALKSINPAKEKSPWIDEIDEYPVHVPRVATVSSS

SEQ ID NO: 15579 - protein, 518 aa, Medicago truncatula
MEEQNNQQNHYSRRSISFERSKLPNFLISVKLKYVKLGYHYLISNAMYLVLIPLLGVASVHLSTFSIKDLIQIYENLKFNFVSMLICTSLVVFLATLYFMSRPRGIYLVDFACYKPQKDLQVTREIFVERSILTKAFTEETLSFQKKILERSGLGQKTYLPPAIMRVPPNPCMAEARKEAEEVMFGAIDEVLQKTGVKAKDIGILVVNCSLFNPTPSLSAMIVNHYKLRGNILSYNLGGMGCSAGLISIDLAKQLLQVHPNSYALVVSMENITLNWYFGNDRSMLVPNCLFRMGGAAVLLSNKPRDRLRSKYQLVHTVRTHKGADNKSYGCVFQEEDDTKQVGVSLSKDLMAVAGEALKTNITTLGPLVLPMSEQLLFFGTLVARKIFKMKIKPYIPDFKLAFEHFCIHAGGRAVLDELEKNLDLSDWHMEPSRMTLNRFGNTSSSSLWYELAYTEAKGRIKKGDRTWQIAFGSGFKCNSAVWKALKTINPAKEKNPWIDEIHEFPVHVPKVSKVIGS

SEQ ID NO: 15580 - protein, 529 aa, Manihot esculenta
MAEDSRQNPEPESVSVEAQPEIKRNNLPNFLLSVRLKYVKLGYHYLISSALYLLLIPLLGIASAHLSTLTIQDLIQIWNHLKFNFVSVTLCSGLIVFLATLYFMSRPRKVYLVNFACYKPEEARMCTREIFMERSGLAGSFTEENLAFQKKILERSGLGQKTYLPEAVMRVPPNPCMAEARKEAETVMFSAIDELLDKTGVKAKDIGILVVNCSLFNPTPSLSAMIVNHYKLRGNIMSYNLGGMGCSAGLISIDLAKQLLQVHPNSYALVVSMENITLNWYFGNDRSMLVSNCLFRMGGAAILLSNRSSDGRRSKYQLIHTVRTHKGADDKCYNCVFQREDESERKRIGVSLSKDLMAVAGEALKTNITTLGPLVLPMSEQLLFFATLVARKVFKMKIKPYIPDFKLAFEHFCIHAGGRAVLDELEKNLDLSDWHMEPSRMTLYRFGNTSSSSLWYELAYSEAKGRIRKGDRTWQIAFGSGFKCNSAVWRALKTINPAKEKNPWMDEIDEFPVHVPKVVSINSSSTSSH

SEQ ID NO: 15581 - protein, 523 aa, Manihot esculenta
MAEESRRNPKPESVSVEDQAEIKRNNLPNFLLSVRLKYVKLGYHYLISNAMYLLLIPLLGIASAHLSTLTIQDLVQLWNHLKFNFISVILGSGLVVLLATLYFMSRPRKIYLLDFACYKPEEARICTRETFMDRSALAGSFTEENLGFQKKILERSGLGQKTYLPEAVLRVPPNPCMAEARKEAETVMFSAIDQLLAKTGVKAKDIGILIVNCSLFNPTPSLSAMIVNRYKLRGNVISYNLGGMGCSAGLISIDLAQQLLQVHPNSYALVVSMENITLNWYFGNDRSMLVSNCLFRMGGAAILLSNRSSDGRRSKYQLIHTVRTHKGADDKCYNCVFQKEDESDRSRIGVSLSKDLMAVAGEALKTNITTLGPLVLPMSEQILFFATLVGRKVFKMKIKPYIPDFKLAFEHFCIHAGGRAVLDELEKNLDLTDWHMEPSRMTLYRFGNTSSSSLWYELAYSEAKGRIRKGDRTWQIAFGSGFKCNSAVWRALKTINPATEKNPWMDEIDEFPVHVPKVVSIAS

SEQ ID NO: 15582 - protein, 522 aa, Citrus sinensis
MAVDQKNKPNPNPEAEGRGNNNNKLPNFLLSVRLKYVKLGYHYIISNALYLLLVPILIISSAHLSTLSVQDIVQLWNQLRYNLVTVTVCSSLMVFLGTLYFMSRPRKVYLVDFACYKPEPERQCTREIFMERSEQIGCFSEENLAFQKKILERSGLGQHTYFPEAVLRVPPNPCMAEARNEAEMVMFGAIDELLSKTGVKAKDIGILVVNCSLFCPTPSLSAMIVNHYKLRGNITSYNLGGMGCSAGLISIDLAKQLLQVHPNSYALVVSMENITLNWYFGNDRSMLVSNCLFRMGGAAILLSNRSSDRRRSKYQLIHTVRTHKGADDKCYNCVFQREDDTKRVGVSLSKDLMAVAGEALKTNITTLGPIVLPMSEQLLFFATLVAKKVFKMKIKPYIPDFKLAFEHFCIHAGGRAVLDELEKNLELSEWHMEPSRMTLYRFGNTSSSSLWYELAYSEAKGRMRKGDRTWQIAFGSGFKCNSAVWQALRTINPAKEKNPWIEEIHEFPVHVPRVAAVDLKAS

SEQ ID NO: 15583 - protein, 526 aa, Ricinus communis
MAEESIRNSPPESVRVEAQPPEMKRNNLPNFLLSVRLKYVKLGYHYLISNAMYLLLVPLLGIASAQLSTLKIEDLVQLWNHLKFNFVSVTLCSGLIVFLATLYFMSRPRKIYLVNFACYKPEPARICTRETFMEKSAMAGSFTEENLAFQKKILERSGLGQKTYLPEAVMRVPPNPCMAEARKEAETVMFSAIDELLGKTGVKAKDLGILIVNCSLFNPTPSLSAMIINHYKLRGNILSYNLGGMGCSAGLISIDLAKQLLQVQPNSYALVVSMENITLNWYFGNDRSMLVSNCLFRMGGAAILLSNRSSDRRRSKYQLIHTVRTHKGADDKCYNCVFQKEDESDKKRIGVSLSKDLMAVAGEALKTNITTLGPLVLPMSEQLLFFATLVARKVFKMKIKPYIPDFKLAFEHFCIHAGGRAVLDELEKNLDLAEWHMEPSRMTLYRFGNTSSSSLWYELAYSEAKGRIRKGDRTWQIAFGSGFKCNSAVWRALKTINPAKEKNPWMDEIDDFPVHVPKVVSISSSS

SEQ ID NO: 15584 - protein, 260 aa, Ricinus communis
MAEESIRNSPPESVRVEAQPPEMKRNNLPNFLLSVRLKYVKLGYHYLISNAMYLLLVPLLGIASAQLSTLKIEDLVQLWNHLKFNFVSVTLCSGLIVFLATLYFMSRPRKIYLVNFACYKPEPARICTRETFMEKSAMAGSFTEENLAFQKKILERSGLGQKTYLPEAVMRVPPNPCMAEARKEAETVMFSAIDELLGKTGVKAKDLGILIVNCSLFNPTPSLSAMIINHYKLRGNILSYNLGGMGCSAGLISIDLAKQF

SEQ ID NO: 15585 - protein, 522 aa, Citrus clementina
MAVDQKNKPNPNPEAEGRGNNNNKLPNFLLSVRLKYVKLGYHYLISNALYLLLVPILIISSAHLSTLSVQDIVQLWNQLRYNLVTVTVCSSLMVFLGTLYFMSRPRKVYLVDFACYKPEPERQCTREIFMERSEQIGCFSEENLAFQKKILERSGLGQHTYFPEAVLRVPPNPCMAEARNEAEMVMFGAIDELLSKTGVKAKDIGILVVNCSLFCPTPSLSAMIVNHYKLRGNITSYNLGGMGCSAGLISIDLAKQLLQVHPNSYALVVSMENITLNWYFGNDRSMLVSNCLFRMGGAAILLSNRSSDRRRSKYQLIHTVRTHKGADDKCYNCVFQREDDTKRVGVSLSKDLMAVAGEALKTNITTLGPIVLPMSEQLLFFATLVAKKVFKMKIKPYIPDFKLAFEHFCIHAGGRAVLDELEKNLELSEWHMEPSRMTLYRFGNTSSSSLWYELAYSEAKGRMRKGDRTWQIAFGSGFKCNSAVWQALRTINPAKEKNPWIDEIHEFPVHVPRVAAVDLKAF

SEQ ID NO: 15586 - protein, 519 aa, Tabernaemontana elegans
MGDEKRGASESGSISVESERRSNNLPNFLLSVRLKYVKLGYHYLISHAMYLMLIPLLGVVSVHLSTVTVEDAVLLWNQLRFNLVTVILCSALMVFLGTLYFMTRPRKVYLVDFACHKPGPEFMCSKELFMERSNQAQTFNDENLAFQKKILERSGLGQKTYFPEALLQLPANPCMAEARKEAEMIMFGAIDQLLAKTGVKAKDIGILVVNCSLFCPTPSLSAMIVNHYKLRGNILSYNLGGMGCSAGLISIDLAKQLLQVHPNSYALVVSMENITLNWYFGNNRSMLVSNCIFRMGGAAILLSNKSSDRRRSKYQLIHTVRTHKGADDRSYGCVFQEEDENKEIGVALSKDLMAVAGEALKTNITTLGPLVLPMSEQLLFFVTLVARKVFNMKIKPYIPDFKLAFEHFCIHAGGRAVLDELEKNLDLSEWQMEPSRMTLYRFGNTSSSSLWYELAYSEAKGRIRKGDRTWQIAFGSGFKCNSAVWRALRTINPAKEKNPWMDEIDEFPVQVPRVSTIAS

SEQ ID NO: 15587 - protein, 529 aa, Gossypium raimondii
MAEESKQRRNVEPVKVQTASSSEERRSNNNLPNFLLSVRLKYVKLGYHYVISNAMYLMLVPLLGIASVHLSTLTLLDFVRLWNQLKFNLVSVTLCSGLLVFLATLYFMSRPRKVYLVNFACYKPEADRICTREIFMERSGLTGSFTEENLAFQKKILERSGLGQKTYLPEAVMRVPPNPCMAEARKEAETVMFGAIDELLDKTGVKAKDIGILVVNCSLFNPTPSLSAMVVNRYKLRGNILSYNLGGMGCSAGLISIDLAKQLLQVHPSSYALVVSMENITLNWYFGNDRSMLVSNCLFRMGGAAILLSNRSSDRHRSKYQLIHTVRTHKGADDKCYNCVFQREDDTKRIGISLSKDLMAVAGEALKTNITTLGPLVLPMSEQLLFFVTLVARKVLKMKIKPYIPDFKLAFEHFCIHAGGRAVLDELEKNLDLTDWHMEPSRMTLYRFGNTSSSSLWYELAYSEAKGRIRKGDRTWQIAFGSGFKCNSAVWKALKTINPAKEKSPWIDEIDEFPVHVPRVANIASSSKS

SEQ ID NO: 15588 - protein, 528 aa, Gossypium hirsutum
MAEESKQRRNVEPVKVQTAPSSEERSNNNLPNFLLSVRLKYVKLGYHYVISNAMYLMLVPLLGIASVHLSTLTLLDFVRLWNQLKFNLVSVTLCSGLLVFLATLYFMSRPRKVYLVNFACYKPEADRICTREIFMERSGLTGSFTEENLAFQKKILERSGLGQKTYLPEAVMRVPPNPCMAEARKEAETVMFGAIDELLDKTGVKAKDIGILVVNCSLFNPTPSLSAMVVNRYKLRGNILSYNLGGMGCSAGLISIDHAKQLLQVHPSSYALVVSMENITLNWYFGNDRSMLVSNCLFRMGGAAILLSNRSSDRHRSKYQLIHTVRTHKGADDKCYNCVFQREDDTKRIGISLSKDLMAVAGEALKTNITTLGPLVLPMSEQLLFFVTLVARKVLKMKIKPYIPDFKLAFEHFCIHAGGRAVLDELEKNLDLTDWHMEPSRMTLYRFGNTSSSSLWYELAYSEAKGRIRKGDRTWQIAFGSGFKCNSAVWKALKTINPAKEKSPWIDEIDEFPVHVPRVANIASSSKS

SEQ ID NO: 15589 - protein, 529 aa, Gossypium raimondii
MAEESKQRRNVEPVKVQTASSSEERRSNNNLPNFLLSVRLKYVKLGYHYVISNAMYLMLVPLLGIASVHLSTLTLLDFVRLWNQLKFNLVSVTLCSGLLVFLATLYFMSRPRKVYLVNFACYKPEADRICTREIFMERSGLTGSFTEENLAFQKKILERSGLGQKTYLPEAVMRVPPNPCMAEARKEAETVMFGAIDELLDKTGVKAKDIGILVVNCSLFNPTPSLSAMVVNRYKLRGNILSYNLGGMGCSAGLISIDLAKQLLQVHPNSYALVVSMENITLNWYFGNDRSMLVSNCLFRMGGVAILLSNRSSDRHRSKYQLIHTVRTHKGADDKCYNCVFQREDDTKRIGISLSKDLMAVAGEALKTNITTLGPLVLPMSEQLLFFVTLVARKVLKMKIKPYIPDFKLAFEHFCIHAGGRAVLDELEKNLDLTDWHMEPSRMTLYRFGNTSSSSLWYELAYSEAKGRIRKGDRTWQIAFGSGFKCNSAVWKALKTINPAKEKSPWIDEIDEFPVHVPRVANIASSSKS

SEQ ID NO: 15590 - protein, 524 aa, Populus trichocarpa
MAEDQRKQRLGPESVTVHDEEPAETKRNTLPNFLLSVKLKYVKLGYHYLISNAMFLLLIPLLFIASAHLSTLTIQDFVQLWNHLKFNFVSVTVCSGLLVFLATLYFTSRPRKIYLLDFACYKPEPARMCTRETFMEKSVLAGSFSEENIAFQKKIIERSGLGQNTYFPEAVMRITPRPGMEDARKEAEMVMFGAIDELLAKTGVKAKDIGILIVNCSLFNPTPSLSAMVVNHYRLRGNILSYNLGGMGCSAGLISIDLAKQLLQVHPNSYALVISMENITLNCYFGNDRSMLVSNCLFRMGGAAILLSNRSSDRRRSKYQLIHTVRTHKGADDKCYNCVFQKEDNTRRVGVSLSKDLMAVAGEALKTNITTLGPLVLPMSEQLLFFATLVGRKIFKMKIKPYIPDFKLAFEHFCIHAGGRAVLDELEKNLELSDWHMEPSRMTLYRFGNTSSSSLWYELAYSEAKGRIRKGDRTWQIAFGSGFKCNSAVWHALRTINPAKEKNPWVDEIDEFPVHVPKVVPIAS

SEQ ID NO: 15591 - protein, 523 aa, Quercus alba
MGDERKQTPETVPVSVQTLPERKKNKLPNFLLSVRLKYVKLGYHYLISNAMYLLLVPLLGMTSAHLSMLTLQDVLQLWDNLIKFNLVSVTIGSCVMVFLATFYFTSRPRKVYLVNFACYKPEEARICRREIFIERSTLTGTFTEENLAFQKKILERSGLGQKTYLPEAVLRVPPNPCMAEARKEAEAVMFGAIDELLAKTGVKAKDIGILVVNCSLFNPTPSLSSMIVNHYKLRGNILSYNLGGMGCSAGLISIDLAKQLLQVHPNSYALVMSMENITLNWYFGNDRSMLVSNCLFRMGGAAILLSNHSSDRRRSKYQLIHTVRTHKGADDKCYNCVFQKEDETKRIGVSLSKDLMAVAGEALKTNITTLGPLVLPMSEQLLFFATLVGRKIFKMKIKPYIPDFKLAFEHFCIHAGGRAVLDELEKNLELTDWQMEPSRMTLNRFGNTSSSSLWYELAYTEAKGRIKKGDRTWQIAFGSGFKCNSAVWRALKTIDPAKEKSPWVDEIDEFPVHVPKVSAINVS

SEQ ID NO: 15592 - protein, 524 aa, Populus trichocarpa
MAEDQSKQRLGPESVTVHDREPAETKRNTLPNFLLSVKLKYVKLGYHYLISNAMFLLLIPLLFIASAHLSTLTIQDFVQLWNHLKFNFVSVTVCSGLLVFLATLYFTSRPRKIYLLDFACYKPEPARMCTRETFMETSALAGSFSEENLAFQKKIIERSGLGQNTYFPEAVMRITPRPGMEDARKEAEMVMFGAIDELLAKTGVKAKDIGILIVNCSLFNPTPSLSAMVVNHYRLRGNILSYNLGGMGCSAGLISIDLAKQLLQVHPNSYALVISMENITLNRYFGNERSMLVSNCLFRMGGAAILLSNRSSDRRRSKYQLIHTVRTHKGADDKCYNCVFQKEDNTRRVGVSLSKDLMAVAGEALKTNITTLGPLVLPMSEQLLFFATLVGRKIFKMKIKPYIPDFKLAFEHFCIHAGGRAVLDELEKNLELSDWHMEPSRMTLYRFGNTSSSSLWYELAYSEAKGRIRKGDRTWQIAFGSGFKCNSAVWHALRTINPAKEKNPWVDEIDEFPVHVPKVVPMAS

SEQ ID NO: 15593 - protein, 513 aa, Solanum lycopersicum
MGDESTRRVSIEANSNKLPNFLLSVRLKYVKLGYHYLISHAMYLFLIPILIALFAHLSTITMEDMVQLWNQLKFNLVTVILCSALIVFLATLYFMTRPRKVYLVDFSCYKPKPEVMCPKELFMERSKLAGIFTEENLAFQKKILERSGLGQKTYFPEALLKLPPNPCMAEARKEAEMVMFGAIDELLEKTGVKAKDIGILVVNCSLFNPTPSLSAMIVNHYKLRGNILSYNLGGMGCSAGLISIDLAKQMLQVQPNSYALVVSMENITLNWYFGNNRSMLVSNCIFRMGGAAILLSNKSSDRKRSKYQLIHTVRTHKGADDKSYGCVFQEEDDNKKIGVALSKDLMAVAGEALKTNITTLGPIVLPMSEQLLFFATLVARKVLKMKIKPYIPDFKLAFEHFCIHAGGRAVLDELEKNLELSEWHMEPSRMTLYRFGNTSSSSLWYELAYTEAKGRIKKGDRTWQIAFGSGFKCNSAVWCALRTINPAKEKNPWMDEIDEFPVEVPRVVTINDS

SEQ ID NO: 15594 - protein, 533 aa, Gossypium raimondii
MTEASKKSMNPEPVHVQSTASSNETRSNNNLPNFLLSVRLKYVKLGYHYLISNAMYLMLVPLLAIASAHLSTLTVLDFVQLWDQLKFNLVSVTLCSGLLVFLATLYFMSRPRKVYLVDFACYKPEPERTCTREIFMERSGLTGSFTEENLAFQKKILERSGLGQKTYLPEAVLRVPPNPCMAEARKEAEAVMFGAIDELLEKTGVKAKDIGILVVNCSLFNPTPSLSAMIVNRYKLRGNILSYNLGGMGCSAGLISIDLAKQMLQVHPNSYALVVSMENITLNWYFGNDRSMLVSNCLFRMGGAAILLSNRSSDRRRSKYQLIHTVRTHKGADDKCYNCVFQREDDTKRIGVSLSKDLMAVAGEALKTNITTLGPLVLPMSEQLLFFITLVARKVFKMKIRPYIPDFKLAFEHFCIHAGGRAVLDELEKNLELSDWHMEPSRMTLYRFGNTSSSSLWYELAYSEAKGRIRKGDRTWQIAFGSGFKCNSAVWKALKTINPAKEKSPWIDEIDEYPVYVPKVATVSSSSSSQKTI

SEQ ID NO: 15595 - protein, 533 aa, Gossypium hirsutum
MTEASKKSMNPEPVHVQSTASSNETRSNNNLPNFLLSVRLKYVKLGYHYLISNAMYLMLVPLLAIASAHLSTLTVLDFVQLWDQLKFNLVSVTLCSGLLVFLATLYFMSRPRKVYLVDFACYKPEPERTCTREIFMERSGLTGSFTEENLAFQKKILERSGLGQKTYLPEAVLRVPPNPCMAEARKEAEAVMFGAIDELLEKTGVKAKDIGILVVNCSLFNPTPSLSAMIVNRYKLRGNILSYNLGGMGCSAGLISIDLAKQMLQVHPNSYALVVSMENITLNWYFGNDRSMLVSNCLFRMGGAAILLSNRSSDRRRSKYQLIHTVRTHKGADDKCYNCVFQREDDTKRIGVSLSKDLMAVAGEALKTNITTLGPLVLPMSEQLLFFITLVARKVFKMKIRPYIPDFKLAFEHFCIHAGGRAVLDELEKNLELSDWHMEPSRMTLYRFGNTSSSSLWYELAYSEAKGRIRKGDRTWQIAFGSGFKCNSAVWKALKTINPAKEKSPWIDEIDEYPVYVPKVATVSSSSSSQKAI

SEQ ID NO: 15596 - protein, 520 aa, Populus trichocarpa
MAEDQSKQKPKPESVTVDAETKRNRLPYFLLSVRLKYVKLGYHYLISSAMYLLLVPLLFIASAHLSTLTIRDFVQLWNHLKFNFVSVTLCSGLVVFLATLYFMSRPRKIFLVDFACYKPEPARMCTRETFMEKSAVAGCFSEENLAFQKKILERSGLGQNTYFPEAVMRVTPRPCMEDARKEAEMVMFGAIDELLAKTGVKAKDIGVLIVNCSLFNPTPSLSAMVINHYKLRGNILSYNLGGMGCSAGLISIDLAKQLLQVLPNSYALVISMENITLNWYFGNDRSMLVSNCLFRMGGAAILLSNRPSDRRRSKYQLIHTVRTHKGADDKCYNCVFQKEDDTKRIGVSLSKDLMAVAGEALKTNITTLGPLVLPMSEQLLFFATLVGRKIFKLNIKPYIPDFKLAFEHFCIHAGGRAVLDELEKNLELSDWHMEPSRMTLYRFGNTSSSSLWYELAYSEAKGRIRKGDRTWQIAFGSGFKCNSAVWYALRTINPAKEKNPWIDEIDEFPVHVPKVVSIAS

SEQ ID NO: 15597 - protein, 533 aa, Gossypium hirsutum
MTEASKKSMNPEPVHVQSTASSNETRSNNNLPNFLLSVRLKYVKLGYHYLISNAMYLMLVPLLAIASAHLSTLTVLDFVQLWDQLKFNLVSVTLCSGLLVFLATLYFMSRPRKVYLVDFACYKPEPERTCTREIFMERSGLTGSFTEENLAFQKKILERSGLGQKTYLPEAVLRVPPNPCMAEARKEAEAVMFGAIDELLEKTGVKAKDIGILVVNCSLFNPTPSLSAMIVNRYKLRGNILSYNLGGMGCSAGLISIDLAKQMLQVHPNSYALVVSMENITLNWYFGNDRSMLVSNCLFRMGGAAILLSNRSSDRRRSKYQLIHTVRTHKGADDKCHNCVFQREDDTKRIGVSLSKDLMAVAGEALKTNITTLGPLVLPMSEQLLFFITLVARKVFKMKIRPYIPDFKLAFEHFCIHAGGRAVLDELEKNLELSDWHMEPSRMTLYRFGNTSSSSLWYELAYSEAKGRIRKGDRTWQIAFGSGFKCNSAVWKALKTINPAKEKSPWIDEIDEYPVYVPKVATVSSSSSSQKTI

SEQ ID NO: 15598 - protein, 521 aa, Solanum phureja
MGDESTRRVSIEANHHDDQRINSNKLPNFLLSVRLKYVKLGYHYLISHAMYLFLIPILIALFAHLSTITMEDMVQLWNQLKFNLVTVILCSALIVFLATLYFMTRPRKVYLVDFSCYKPKPEVMCPKELFMERSKLAGIFTEENLAFQKKILERSGLGQKTYFPEALLKLPPNPCMAEARKEAEMVMFGAIDELLEKTGVKAKDIGILVVNCSLFNPTPSLSAMIVNHYKLRGNILSYNLGGMGCSAGLISIDLAKQMLQVQPNSYALVVSMENITLNWYFGNNRSMLVSNCIFRMGGAAILLSNKSSDRRRSKYQLIHTVRTNKGADDKSYGCVFQEEDDSKKIGVALSKDLMAVAGEALKTNITTLGPIVLPMSEQLLFFATLVARKVLKMKIKPYIPDFKLAFEHFCIHAGGRAVLDELEKNLELSEWHMEPSRMTLYRFGNTSSSSLWYELAYTEAKGRIKKGDRTWQIAFGSGFKCNSAVWCALRTIDPAKEKNPWMDEIDEFPVEVPRVVTINDS

SEQ ID NO: 15599 - protein, 529 aa, Tripterygium wilfordii
MVEENRQNARPESSVVVEGRENKLPNFLSSVRLKYVKLGYHYLISNAMYLLLLPLLLISSAHLSTFTVENFMQLWSHLKFNFVSATLCSGLIVFLATLYLTSRPRKVYLVDFACYKPPTERICTREIFMERSTLAGSFTEENLAFQKKILERSGLGQKTYLPEAVLRVPPNPCMAEARKEAETVMFNAIDELLSKTGVKAKDIGILVVNCSLFNPTPSLSAMIVNHYKLRGNILSFNLGGMGCSAGLISIDLAKQLLQVNPNSYALVVSMENITLNWYFGNERSMLVSNCLFRMGGAAILLSNRSSDSRRSKYQLIHTVRTHKGADDRCYNCVFQQEDSSKEIGVALSKDLMAVAGEALKTNITTLGPLVLPMSEQLLFFATLVARKVFKMKIKPYIPDFKLAFEHFCIHAGGRAVLDELEKNLELSEWHMEPSRMTLNRFGNTSSSSLWYELAYSEAKGRIKKGDRTWQIAFGSGFKCNSAVWKALRTINPAKEKNPWVDEIHEFPVHVPKVAAINGSNNGSPHSLFT

SEQ ID NO: 15600 - protein, 342 aa, Olea europaea
MGNEDLINPEPQKISVERGNNLPNFLLSVRLKYVKLGIYYLFSNAMYLFLVPLLGAVSVHLSTVSVEDLVLLWNQLKFNLVSVILCSALMVFLGTLYFMTRPRKVYLVDFACYKPKPEAVCSKEVFVERSKIAGTFTDENLAFQKKILERSGLGQKTYFPEALLRVPANPCMAEARKEAEMVMFGAIDDLLAKTRIKAKDIGILVVNCSLFNPTPSLSAMIVNHYKLRGNILSYNLGGMGCSAGLISIDLAKQLLQVNPNSYALVVSMENITLNWYWGNNRSMLVSNCIFRMGGAAILLSNKSSDRRRAKYQLTHTVRTHKGADDKSYGCVFQEEDESKKLA

SEQ ID NO: 15601 - protein, 519 aa, Amsonia hubrichtii
MGDEKRGASESGKISVESERRSNNLPNFLLSVRLKYVKLGYHYLISNAMYLMLIPLLGVVSVHLSTVTVEDVFLLWDQLRFNLVTVILCSALMVFLGTLYFMTRPRKVYLVDFACYKPGPEFMCSKELFMERSTQAETFNDENLAFQKKILERSGLGQKTYFPEALLQVPANPCMAEARKEAEMVMFGAIDQLLEKTGVKAKDIGILVVNCSLFCPTPSLSAMIVNHYKLRGNILSYNLGGMGCSAGLISIDLAKQLLQVQPNSYAMVVSMENITLNWYWGNNRSMLVSNCIFRMGGAAILLSNKSSDRRRSKYQLIHTVRTHKGADDRSYGCVFQEEDENKKIGVALSKDLMAVAGEALKTNITTLGPLVLPMSEQLLFFVTLVARKVFNMKIKPYIPDFKLAFEHFCIHAGGRAVLDELEKNLDLSEWQMEPSRMTLYRFGNTSSSSLWYELAYSEAKGRIRKGDRTWQIAFGSGFKCNSAVWRALRTINPAKEKSPWIEEIDEFPVQVPRVATIGS

SEQ ID NO: 15602 - protein, 529 aa, Gossypium hirsutum
MAEESKQRRNVKPVKVQTASSSEERRSNNNLPNFLLSVRLKYVKLGYYYVISNAMYLMLVPLLGIASVHLSTLTIQDFVRLWDQLKFNLVSVTLCSGLLVFLATLYFMSRPRKVYLVNFACYKPEADRICTREIFMERSGLTGSFTGENLAFQKKILERSGLGQKTYLPEAVMRVPANPCMAEARKEAETVMFGAIDELLDKTGVKAKDIGILVVNCSLFNPTPSLSAMVVNRYKLRGNILSYNLGGMGCSAGLISIDLAKQLLRVHPNSYALVVSMENITLNWYFGNDRSMLLSNCLFRMGGVAILLSNHSSDRHRSKYQLIHTVRTHKGADDKCYNCVFQREDDTKRIGISLSKDLMAVAGEALKTNITTLGPLVLPMSEQLLFFVTLVARKVLKMKIKPYIPDFKLAFEHFCIHAGGRAVLDELEKNLDLTDWHMEPSRMTLYRFGNTSSSSLWYELAYSEAKGRIRRGDRTWQIAFGSGFKCNSAVWKALKTINPAKEKSPWIDEIDEFPVHVPGVANIASSYKS

SEQ ID NO: 15603 - protein, 524 aa, Sesamum indicum
MGHENEQKQQPETGKISVESTSSEGRGANNLPNFLQSVRLKYVKLGYHYLISHAMYLFLVPLLGILSVHLSTITTDDLVLLWDQLKFNLVSVVICSALIVFLGTLYFMTRPRKVYLVDFACYKPKPEVMCSKEMFMEKSRAAGIFTPENLEFQKRILERSGLGQKTYFPEALMRVPANPCMAEARKEAEMVMFGAIDDLLAKTGVKAKDIGILVVNCSLFNPTPSLSAMIVNHYKLRGNILSYNLGGMGCSAGLISIDLAKQLLQVNPNSYALVVSMENITLNWYFGNNRSMLVSNCIFRMGGAAILLSNKPSDRRRAKYQLIHTVRTHKGADDKSYGCVFQEEDDTKRVGVALSKDLMAVAGEALKTNITTLGPLVLPMSEQLLFFVTLVARKVFKMKIKPYIPDFKLAFDHFCIHAGGRAVLDELEKNLELSKWHMEPSRMTLYRFGNTSSSSLWYELAYTEAKGRIRKGDRTWQIAFGSGFKCNSAVWRALRRIDPAKEKNPWMDEIDEFPVEVPRVATLA

SEQ ID NO: 15604 - protein, 521 aa, Prunus persica
MAAQDHNQEGKSNLGPESSGGRKALPNFLLSVRLKYVKLGYHYLISNAVYFLLVPLMAVASAHLSTLTLEDFVQLWHQLKFNFVSVTLCSGLLVFLTTLYFTTRPRKVYLMNFACYKPEYAITCTRELFMERSKLTGSFSDENLAFQQKILERAGLGQKTYMPEAVMRVPPNPCMAEARKEAEMVMFGAIDELLEKTGVKPKDIGILVVNCSLFNPTPSLSAMVVNHYKLRGNIVSYNLGGMGCSAGLISIDLAKQLLQVHPNSYALVVSMENITLNWYFGNDRSMLLSNCLFRLGGAAILLSNRSSDRRRSKYQLMHTVRTHKGSDDKAYSCVFQREDDTKRVGVALSKDLMAVAGEALKTNITTLGPIVLPMSEQLLFFVTLVARKVFKMKNIKPYIPDFKLAFEHFCIHAGGRAVLDEMEKNLELSDWHMEPSRMTLYRFGNTSSSSLWYELAYSEAKGRVRKGDRMWQIAFGSGFKCNSAVWKALRTVNPAKEKNPWIDEIDQFPVDVPKVAPCKAS

SEQ ID NO: 15605 - protein, 533 aa, Gossypium hirsutum
MTEASKKSMNPDPVHVQSTASSNETRSNNNLPNFLLSVRLKYVKLGYHYLISNAMYLMLVPLLAIASAHLSTLTVLDLVQLWDQLKFNLVSVTLCSGLLVFLATLYFMSRPRKVYLVDFACYKPEPERTCTREIFMERSNLTGSFTEENLAFQKKILERSGLGQKTYLPEAVLRVPPNPCMAEARKEAEAVMFGAIDELLEKTGVKAKDIGILVVNCSLFNPTPSLSAMIVNRYKLRGNILSYNLGGMGCSAGLISIDLAKQMLQVHPNSYALVVSMENITLNWYFGNDRSMLVSNCLFRMGGAAILLSNRSSDRRRSKYQLIHTVRTHKGADDKCYNCVFQREDDTKRIGVSLSKDLMTVAGEALKTNITTLGPLVLPMSEQLLFFITLVARKVFKMKIRPYIPDFKLAFEHFCIHAGGRAVLDELEKNLELSDWHMEPSRMTLYRFGNTSSSSLWYELAYSEAKGRIRKGDRTWQIAFGSGFKCNSAVWKALKTINPAKEKSPWIDEIDEYPVYVPKVATVSSSSSSQKAI

SEQ ID NO: 15606 - protein, 522 aa, Aquilegia formosa
MEDKKQKQDTNSVSVHVPSSSAKKKLPDFLQSVKLKYVKLGYHYLITHAMYLLLIPILAIASARISLLSIDDVTELWNQLRFNLVSVIICSALLVFVATLYFMSRPRKIYLLDFACYKPEPERTCTREIFMERSTITGSFTEENLAFQQKILERSGLGQSTYLPEAVLQVPPNPCMAEARKEAEVVMFGAVDELLAKTGVKAKDIGILVVNCSLFNPTPSLSAMLVNHYKLRGNIVSYNLGGMGCSAGLISIDLAKQLLQVHPNSYALVVSMENITLNWYFGNNRSMLVSNCLFRMGGAAILLSNRSTDRRRSKYQLIHTVRTHKGADNSSFNCVYQEEDDTGRVGVALSKNLMAVAGEALKTNITTLGPIVLPMSEQLLFFATLVARKVLKMKIKPYIPDFKLAFEHFCIHAGGRAVLDELEKNLELTDWHMEPSRMTLYRFGNTSSSSLWYELAYSEAKGRIKRGDRTWQIAFGSGFKCNSAVWRALKTINPAKEKNPWMSEIDQFPVHVPKVSSVISNN

SEQ ID NO: 15607 - protein, 519 aa, Platanus occidentalis
MEETRQYPESETVSLQVPQRSRNKLPDFLLSVKLKYVKLGYHYVISNAMYLILTPLLVIVSAHLSTVSCDDFLELWNHLKFNLVSVVICSALLVFLATLYFMTRPRKVYLVDFACYKADPSQICTRERFMDLSRLAKTFTEENLAFQKKLAERSGLGQSTYFPEAVLRVPPNPCMAEARKEAETVMFGAIDQLLAKTGVKAKDIGILVVNCSLFNPTPSLSAMIVNHYKLRGNVLSYNLGGMGCSAGLISIDLAKKLLQVEPNSYALVVSMENITQNWYWGNNRSMLLCNCLFRMGGAAILLSNRPADRRRSKYQLIHTVRTHKGADDRCYKCVYQEEDDTGRVGVALSKDLMAVAGEALKANITTLGPLVLPMSEQLLFFATLVGRQVFKMKIKPYIPDFKLAFEHFCIHAGGRAVLDELEKNLQLSEWHMEPSRMTLYRFGNTSSSSLWYELAYSEAKGRIKKGDRTWQIAFGSGFKCNSAVWRALRTIDPAKEKNPWIGEIDGFPVPVPKISPITS

SEQ ID NO: 15608 - protein, 421 aa, Catharanthus roseus
MVFLGTLYFMTRPRKVYLVDFSCYKPNPEFMCPKELFMERSHQAETFSDENLAFQKKILERSGLGQKTYFPGALLQVPANPCMAEARKEAEMVMFGAIDQLLEKTGVKAKDIGILVVNCSLFCPTPSLSAMIVNHYKLRGNILSYNLGGMGCSAGLISIDLAKQLLQVHPNSYALVVSMENITLNWYFGNNRSMLVSNCIFRMGGAAILLSNKSSDRRRSKYQLIHTVRTHKGADDRSYGCVFQEEDENKKIGVALSKDLMAVAGEALKTNITTLGPLVLPMSEQLLFLITLVARKVFNMKIKPYIPDFKLAFEHFCIHAGGRAVLDELEKNLDLSEWHMEPSRMTLYRFGNTSSSSLWYELAYSEAKGRIRKGDRTWQIAFGSGFKCNSAVWKALRTINPAKKRIHGLMKLMISLYRFRE

SEQ ID NO: 15609 - protein, 518 aa, Nicotiana benthamiana
MGDESNGKVSIEAQERCSNNNKLPNFLLSVKLKYVKLGYHYLISHVMYLCLAPILGAVFVHLSTLTVEEVVQLWYQLKFNLVTVILCSALMVFLATLYFMTRPRKVYLVDFSCYKPKPDVMCPKELFMERSKQAGIFTDENLAFQKKILERSGLGQKTYFPEALLKVPPNPCMAEARKEAEMVMFGAIDELLEKTGVKAKDIGILVVNCSLFNPTPSLSAMIVNHYKLRGNIMSYNLGGMGCSAGLISIDLAKQMLQVHPNSYALVVSMENITLNWYFGNNRSMLVSNCIFRMGGAAILLSNKSSDRRRSKYQLIHTVRTHKGADDKSYSCVFQEEDDNKKIGVALSKDLMAVAGEALKTNITTLGPIVLPMSEQLLFFITLVARKVFKMKIKPYIPDFKLAFEHFCIHAGGRAVLDELEKNLELSQWHMEPSRMTLYRFGNTSSSSLWYELAYTEAKGRIKKGDRTWQIAFGSGFKCNSAVWCALRTINPAKEKNPWMDEINEFPVQVPRVVTINDS

SEQ ID NO: 15610 - protein, 519 aa, Solanum phureja
MGDENNKNSVSSETARISVEVNNLPNFLQSIRLKYVKLGYHYLISNAMYLFLVPVLGLLCVHVMTISVDDLIQLLDKLKFNLVTVILCSALVVFLGTLYFMTRPRKVYLVDFSCYKPKPDVMCSKEVFMERSKQAGVFTEENLAFQKKILERSGLGQKTYFPEALLRVPAEPNMAEARKEAEMVMFGAIDELLAKTGVKAKDIGILVVNCSLFNPTPSLSAMIVNHYKLRGNVMSYNLGGMGCSAGLISIDLAKQLLQVNPNSYALVVSMENITLNWYFGNNRSMLVSNCIFRMGGAAILLSNRSSDRRRSKYQLIHTVRTHKGADDRSYGCVFQEEDEKKEIGVALSKDLMAVAGEALKTNITTLGPLVLPMSEQLLFFMTLVARKIFKMKIKPYIPDFKLAFEHFCIHAGGRAVLDELEKNLELSQWHMEPSRMTLYRFGNTSSSSLWYELAYTEAKGRIKKGDRTWQIAFGSGFKCNSAVWRALKTINPAKEKNPWMDEVHEFPVEVPRMVTINDS

SEQ ID NO: 15611 - protein, 343 aa, Petunia hybrida
MGDESTRRVSVETNSTTHERSNKLPNFLLSVRLKYVKLGYHYLISHAMYLCLVPLLGVVSVHLSAITVEDVVQLWDQLKFNLVTVILCSALMVFLATLYFMTRPRKVYLVDFSCYKPQSDVMCPKELFMERSKQAGIFTDENLAFQKKILERSGLGQKTYFPEALLKVPPNPSMAEARKEAEMVMFGAIDELLAKTGVKAKDIGILVVNCSLFNPTPSLSAMIVNHYKLRGNIMSYNLGGMGCSAGLISIDLAKQMLQVNPNSYALVVSMENITLNWYFGKNRSCLFQLHLQNGRAAFYCQINHRIAVVPSINSSTQYVHTRVQMTEAMVVCFKKKMRTKKLV

SEQ ID NO: 15612 - protein, 518 aa, Panax ginseng
MVDEKKLNPETQPVSVENRNNTTLPNFLLSVKLKYVKLGYHYLISHAMYLLLIPLLGVFSAHLSTFSVQDFVEIWNQLKFNSLTVIICSALMIFLVTLYYMRLPKKVYLVDFACYKPEPERMCTKELFMERSAQFGSFSEENLAFQKKILERSGLGQKTYFPEAVMQVPPNICMAEARKEAEMVMFGAIDELLAKTRVKAKDIGILIVNCSLFNPTPSLSAMVVNHYKLRGNILSYNLGGMGCSAGLISIDLAKQLLQVQPNSYALVVSMENITLNWYFGNNRSMLVSNCLFRVGGAAILLSNKSSDRGRSKYQLIHTVRTHKGADDRSYSCVFQEEDQDKKIGVALSKDLMAVAGEALKTNITTLGPLVLPMSEQLLFFFTLVARKVFKMKIKPYIPDFKLAFEHFCIHAGGRAVLDELEKNLELKEWHMEPSRMTLYRFGNTSSSSLWYELAYSEAKGRIRKGHRTWQIAFGSGFKCNSAVWRAMRTINPAKEKNPWIDEIDEFPVHVPRVTQIGS

SEQ ID NO: 15613 - protein, 533 aa, Eucalyptus grandis
MADQQEQISRQNPDQTVPVSVEPRSQDSDRPSKHSLPNFLLSVKLKYVKLGYHYLISKALYLLLVPLLGISSVHLSTLTARDLAQLWDQLRFNLVTVVVCSTLMVFLVTLYFMTRPRKVYLVDFACYKPDPARICTRETFMECSELTKAFTEENLAFQRRILERSGLGQRTYLPEAVLQVPPNPCMAEARAEAETVMFGAVDQLLAKTGVKAKDIGILVVNCSLFNPTPSLSAMIVNHYKLRGNVLSYNLGGMGCSAGLISIDLAKQLLQVHPNSYALVVSMENITLNWYFGNDRSMLVSNCLFRMGGAAILLSNRSSDRRRSKYQLIHTVRTHKGSDDKSYSCVFQREDDKKKIGVSLSKDLMAVAGEALKTNITTLGPLVLPMSEQLLFFMTLVARKVLKMKIRPYIPDFKLAFEHFCIHAGGRAVLDEIEKNLELSDWHMEPSRMTLYRFGNTSSSSLWYELAYSEAKGRIRKGDRTWQIAFGSGFKCNSAVWQALRTVDPAKEKNPWMDDIHEFPVHVPKAVSIGSTTK

SEQ ID NO: 15614 - protein, 518 aa, Nicotiana benthamiana
MGDEPNGKVSIEAQERSSYNNKLPNFLLSVKLKYVKLGYHYLISHVMYLCLAPILGAVFVHLSTLTVEDVVQLWNQLKFNLVTVILCSALMVFLATLYFMTRPRKVYLVDFSCYKPKPDVMCPKELFMERSKQAGIFTDENLAFQKKIVERSGLGQKTYFPESLLKLPPNPCMAEARKEAEMVMFGAIDELLEKTGVKAKDIGILVVNCSLFNPTPSLSAMIVNHYKLRGNIMSYNLGGMGCSAGLISIDLAKQMLQVNPNSYALVVSMENITLNWYFGNNRSMLVSNCIFRMGGAAILLSNKSSDRRRSKYQLIHTVRTHKGADDKSYSCVFQEEDDNKKIGVALSKDLMAVAGEALKTNITTLGPIVLPMSEQLLFFITLVARKVFKMKIKPYIPDFKLAFEHFCIHAGGRAVLDELEKNLELSQWHMEPSRMTLYRFGNTSSSSLWYELAYTEAKGRIKKGDRTWQIAFGSGFKCNSAVWCALRTINPAKEKNPWMDEIDEFPVQVPRVVTINDS

SEQ ID NO: 15615 - protein, 523 aa, Nicotiana benthamiana
MGDEKNKNLVNSEAGRVSIEAKNEKRNNNLPNFLLSVRLKYVKLGYHYLISNAMYVCLVPILGVLSVHLMTISVEDLLQLWDKLKFNLVTVIFCSALVVFLGTLYFMTRPRKVYLVDFSCYKPEPKVMCPKEIFMERSKQAGIFTKENLAFQKKILERSGLGQKTYFPEALMRVPAEPNMVEARKEAEMVMFGAIDELLAKTGVKAKDIGILVVNCSLFNPTPSLSAMIVNHYKMRGNVMSYNLGGMGCSAGLISIDLAKQLLQVNPNSYALVVSMENITLNWYFGNNRSMLVSNCIFRMGGAAILLSNRSSDRRRSKYQLIHTVRTHKGADDRSYGCVFQEEDENKEVGVALSKDLMAVAGEALKTNITTLGPLVLPMSEQLLFFMTLVTRKIFKMKIKPYIPDFKLAFEHFCIHAGGRAVLDELEKNLELSQWHMEPSRMTLYRFGNTSSSSLWYELAYSEAKGRIRKGDRTWQIAFGSGFKCNSAVWQALRTINPAKEKNPWMDEIDDFPVEVPRIVTIG

SEQ ID NO: 15616 - protein, 525 aa, Vinca minor
MGDEKRVPSETGKISVESSQRRSNNNNNNNLPNFLSSVRLKYVKLGYHYLISHAMYLMLVPLLGVVSVHLSTVTVEDVVILWDQLRFNLFTVILCSALMVFLGTLYFMTRPRKVYLVDFACYKPGPEFKCSKELFMERSNQAETFNDENLAFQKKILERSGLGQDTYFPEALLQVPANPCMAEARKEAEMIMFGAIDQLLEKTGVKAKDIGILVVNCSLFCPTPSLSAMIVNHYKLRGNILSYNLGGMGCSVGLISIDLAKQLLQVHPNSYALVVSMENITLNWYFGNNRSMLVSNCIFRMGGAAILLSNKSSDRRRSKYQLIHTVRTHKGADDRSYGCVFQEEDENKEIGVALSKDLMAVAGEALKTNITTLGPLVLPMSEQLLFFVTLVARKVFNMKIKPYIPDFKLAFEHFCIHAGGRAVLDELEKNLELSQWHMEPSRMTLYRFGNTSSSSLWYELAYSEAKGRIRKGDRTWQIAFGSGFKCNSAVWRALRTINPAKEKNPWMEEIYEFPVQVPRVANIGS

SEQ ID NO: 15617 - protein, 518 aa, Panax ginseng
MANEENRNPESETISVEKRPKNALPNFLLSVKLKYVKLGYHHLISNAMYLLLVPLLGIFSVHISTFTVRDFVQIWHHLKFNLVTVIICSALMVFLVTLYYMSRPKKIYLVDFSCYKPDPARMCTKELFMQRSTQNGSFSEENLAFQKRIIERSGLGQKTYFPEAVLQVPPNICMAEARKEAEMVMFGAIDELLGKTGVKAKDIGILIVNCSLFNPTPSLSAMVVNHYKLRGNILSYNLGGMGCSAGLISIDLAKQLLQVQPNSYALVVSMENITLNWYFGNNRSMLVSNCLFRMGGAAILLSNRSSDRRRSKYQLIHTVRTHKGADDRCYNCVFQEEDENKKIGVALSKDLMAVAGEALKTNITTLGPLVLPMSEQLLFFATLVARKIFKMKIKPYIPDFKLAFEHFCIHAGGRAVLDELEKNLELTDSHMEPSRMTLYRFGNTSSSSLWYELAYSEAKGRIRKGDRTWQIAFGSGFKCNSAVWRAIRTINPAMEKNPWIDEIDEFPVHVPRVTQIGS

SEQ ID NO: 15618 - protein, 516 aa, Mimulus guttatus
MGNGDDRKIEPETGRISVERKLPNFLQSIRLKYVKLGYHYLISNAMYLLLIPLLAISSVHLSTLTTQDLTLLWDQLKFNLVSVLVCSTLTVFLCTLYFMTRPRKIYLVDFACYKPKPDVMCSKEMFMEKSRQTGIFTAENLEFQKKILERSGLGQKTYFPEALMRVPAEPNMAEARKEAELVMFGAIDDLLAKTGVKAKDIGILVVNCSLFNPTPSLSAMVVNHYKLRGNILSYNLGGMGCSAGLISIDLAKQLLQVQPNSLALVVSMENITLNWYFGNNRSMLVSNCIFRMGGAAILLSNKPSDKRRSKYQLIHTVRTHRGADDKSYTCVFQEEDDTKQVGVALSKDLMAVAGEALKTNITTLGPLVLPMSEQLLFFVTLVARKVFKMKTIKPYIPDFKLAFEHFCIHAGGRAVLDELEKNLELSEWHMEPSRMTLYRYGNTSSSSLWYELAYTEAKGRIRKGDRTWQIAFGSGFKCNSAVWRALKRVDPAMEKNPWMDEVHDFPVEVPRVATIS

SEQ ID NO: 15619 - protein, 519 aa, Solanum lycopersicum
MGDENKKNSVSSETARISVEVNNLPNFLQSIRLKYVKLGYHYLISNAMYLFLVPVLGVLCVHVMTISVEDLIQLLDKLKFNLITVILCSAVVVFLGTLYFMTRPRKVYLVDFSCYKPKPDVMCSKETFMERSKQAGIFTEENLAFQKKILERSGLGQKTYFPEALLRVPAEPNMAEARKEAEMVMFGAIDELLAKTRVKAKDIGILVVNCSLFNPTPSLSAMIVNHYKLRGNVMSYNLGGMGCSAGLISIDLAKQLLQVNPNSYALVVSMENITLNWYFGNNRSMLVSNCIFRMGGAAILLSNRSTDRRRSKYQLIHTVRTHKGADDRSYGCVFQEEDEKKEIGVALSKDLMAVAGEALKTNITTLGPLVLPMSEQLLFFMTLVARKIFKMKIKPYIPDFKLAFEHFCIHAGGRAVLDELEKNLELSQWHMEPSRMTLYRFGNTSSSSLWYELAYTEAKGRIKKGDRTWQIAFGSGFKCNSAVWRALKTINPAKEKNPWMDEVHEFPVEVPRIVTINDS

SEQ ID NO: 15620 - protein, 521 aa, Malus domestica
MAVQNQNQGEKLNLGPESAGSRKPALPNFLLSVKLKYVKLGYHYLISNALYLLLVPLLAAASAHLSTLTADDFFHLWQQLKFNFVSVTLCSGLLVFLSTVYFTTRPRKIYLVNFACYKPEPARTCTREMFMERSKLTGSFYDENLAFQQKILERSGLGQNTYMPEAVMRVPPNPCMVEARKEAEMVMFGAIDELLEKTGVKAKDIGILVVNCSLFNPTPSLSSMVVNHYKLRGNVVSYNLGGMGCSAGLISIDLAKQLLQVHPNSYALVVSMENITLNWYFGNDRSMLLSNCLFRMGGAAILLSNRSSDHRRSKYQLMHAVRTHKGADDRAYNCVFQKEDDTKRVGVALSKDLMAVAGEALKTNITTLGPIVLPMSEQLLFFATLVARKVFKMKNIKPYIPDFKLAFEHFCIHAGGRAVLDEIEKNLELSDWHMEPSRMTLYRFGNTSSSSLWYELAYSEAKGRVRKGDRMWQIAFGSGFKCNSAVWKALRTVKPAKEKNPWIDEIHEFPVEVPKVSAVAS

SEQ ID NO: 15621 - protein, 521 aa, Malus domestica
MAVQNQNQGEKLNLGPESAGSRKPALPNFLLSVKLKYVKLGYHYLISNALYLLLVPLLAAASAHLSTLTADDFFHLWQQLKFNFVSVTLCSGLLVFLTTVYFTTRPRKIYLVNFACYKPEPARTCTREMFMERSKLTGSFYDENLAFQQKILERSGLGQNTYMPEAVMRVPPNPCMVEARKEAEMVMFGAIDELLEKTGVKAKDIGILVVNCSLFNPTPSLSSMVVNHYKLRGNVVSYNLGGMGCSAGLISIDLAKQLLQVHPNSYALVVSMENITLNWYFGNDRSMLLSNCLFRMGGAAILLSNRSSDHRRSKYQLMHAVRTHKGADDRAYNCVFQKEDDTKRVGVALSKDLMAVAGEALKTNITTLGPIVLPMSEQLLFFATLVARKVFKMKNIKPYIPDFKLAFEHFCIHAGGRAVLDEIEKNLELSDWHMEPSRMTLYRFGNTSSSSLWYELAYSEAKGRVRKGDRMWQIAFGSGFKCNSAVWKALRTVKPAKEKNPWIDEIHEFPVEVPKVSAVAS

SEQ ID NO: 15622 - protein, 502 aa, Cucumis sativus
MADHRLPNFLLSVRLKYVKLGYHYLISNAMYLLLLPFLAALSAHLSTFQFQDFLHLWNILNFNLLSVALCSSLLVFLTTLYVMTRPRKVYLLNFSCYKPHPARTCERGTFLHRSELTGSFTEENLGFQKKILERSGLGEKTYLPEAVMRIPPNPCMDEARKEAEAVMFGAIDELLEKTGVKAKDIGILVVNCSLFNPTPSLSAMIVNHYKLRGNILSYNLGGMGCSAGLISIDLAKQLLQVHPNSYALVVSMENITLNWYFGNDRSMLVSNCLFRMGGAAILLSNRPSDRRRSKYQLIHTVRTHKGSDDKCYNCVFQQEDDTGRVGVRLSKDLMAVAGEALKTNITTLGPLVLPMSEQLLFFATLVAKKIFKIKKIKPYIPDFKLAFEHFCIHAGGRAVLDELEKNLDLSEWHMEPSRMTLNRFGNTSSSSLWYELAYSEAKGRIRKGDRTWQIAFGSGFKCNSAVWRALRTVNPAKEKNPWMDEIHEFPVEVPRVAPIHKP

SEQ ID NO: 15623 - protein, 498 aa, Helianthus annuus
MADLPNFLLSVKLKYVKLGYHYLISHFMYLLLIPLLAVVSVHLSTLTSQDLINLWHHLRFNLLTVIICSTLIVFLATLYFMSRPNKVYLVDFACYKPNDSNTVSRETFMQHSGLAGTFNDENLAFQKKILERSGLGQKTYFPDAVLQVPPNPCMAEARKEAEMVMFGAIDDLLRKTGVKAKDIGVLIVNCSLFCPTPSLSSMVVNHYKLRGNILSYNLGGMGCSAGLISIDLAKQLLQVNPNSYALVVSMENITLNWYFGNNRSMLLSNCLFRMGGAAILLSNRSSDRRRSKYQLVHTVRTHKGADDKCYSCVFQEEDNEKKIGVALSKDLMAVAGEALKTNITTLGPLVLPMSEQLLFFVTLVARKVFKMKIKPYIPDFKLAFEHFCIHAGGRAVLDELEKNLELSEWHMEPSRMTLYRFGNTSSSSLWYELAYCEAKGRIKKGDRSWQIAFGSGFKCNSAVWRALRTIDPTKEKNPWTSEIHEFPVHVPKIAQIDL

SEQ ID NO: 15624 - protein, 527 aa, Citrullus lanatus
FPHNFISSQISILSSSSSSSSSSSTMADHRLPNFLLSVRLKYVKLGYHYLISNAMYLLLLPFLAAVSAHLSTLQFQDFLHLWNHFNFNLLSVTLCSSLLVFLATLYVMTRPRKVYLLNFSCYKPEPARTCERGTFLQRSELTGSFTEENLAFQKKILERSGLGEKTYLPEAVMRVPPNPCMAEARKEAEAVMFGAIDELLEKTGVKAKDIGILVVNCSLFNPTPSLSAMIVNHYKLRGNVLSYNLGGMGCSAGLISIDLAKQLLQVHPNSYALVVSMENITLNWYFGNDRSMLVSNCLFRMGGAAILLSNRPSDRRRSKYQLIHTVRTHKGSDDKCYNCVFQQEDDTGRVGVRLSKDLMAVAGEALKTNITTLGPLVLPMSEQLLFFATLVAKKIFKIKKIKPYIPDFKLAFEHFCIHAGGRAVLDELEKNLDLSEWHMEPSRMTLNRFGNTSSSSLWYELAYSEAKGRIRKGDRTWQIAFGSGFKCNSAVWRALRTVDPAKEKNPWMDEIDEFPVEVPRVAPIHKP

SEQ ID NO: 15625 - protein, 529 aa, Eucalyptus grandis
MADKESKNNHDPGAVSPSARVSVDPQPATRRSTRNLPNFLLSVKLKYVKLGYHYLISNAMYIFLLPLLLVASAHLSTLTADDLTNLWDQLKFNLVAVVLSSAFVVFLITLHFMTRPRRVYLVDFACYKPEPAQKCTREVFMERSALTGNFTAENLTFQRKILERAGLGQDTYLPDAVMRVPPNPCMAEARKEAETVMFGAIDQLLAKTGVKPKDIGILVVNCSLFNPTPSLSAMVVNHYKLRGNILSYNLGGMGCSAGLISIDLAKQLLQVQPNSYALVVSMENITLNWYFGNDRAMLLSNCLFRMGGAAILLSNRSSDRRLSKYQLVHTVRTHKGADDKCYGCVFQREDDTKRIGVSLSKDLMAVAGEALKTNITTLGPLVLPMSEQLLFFVTLVARKVLQMKIKPYIPDFKLAFEHFCIHAGGRAVLDELEKSLELTEHHMEPSRMTLYRFGNTSSSSLWYELAYSEAKGRIRKGDRTWQIAFGSGFKCNSAVWQALRTIDPAKEKNPWMDEIDKFPVDVPKVASIS

SEQ ID NO: 15626 - protein, 519 aa, Solanum lycopersicum
MGDENKKNSVGSETARISVEVNNLPNFLQSIRLKYVKLGYHYLISNAMYLFLVPVLGVLCVHVMTISVEDLIQLLDKLKFNLITVILCSAVVVFLGTLYFMTRPRKVYLVDFSCYKPKPDVMCSKETFMERSKQARIFTEENLAFQKKILERSGLGQKTYFPEALLRVPAEPNMAEARKEAEMVMFGAIDELLAKTRVKAKDIGILVVNCSLFNPTPSLSAMIVNHYKLRGNVMSYNLGGMGCSAGLISIDLAKQLLQVNPNSYALVVSMENITLNWYFGNNRSMLVSNCIFRMGGAAILLSNRSTDGRRSKYQLIHTVRTHKGADDRSYGCVFQEEDEKKEIGVALSKDLMAVAGEALKTNITTLGPLVLPMSEQLLFFMTLVARKIFKMKIKPYIPDFKLAFEHFCIHAGGRAVLDELEKNLELSQWHMEPSRMTLYRFGNTSSSSLWYELAYTEAKGRIKKGDRTWQIAFGSGFKCNSAVWRALKTINPAKEKNPWMDEVHEFPVEVPRIVTINDS

SEQ ID NO: 15627 - protein, 518 aa, Tropaeolum majus
MADAKDHTIHPAETIGNDERKLPNFLLSVKLKYVKLGYHYLISNAMYLLMVPLLAVAFAHLSTLTIQDLVHLWEQLKFNLLSVTLCSSLMVFLGTLYFMSRPTKIYLVDFSCYKPEKERICTREIFYERSKLTGNFTDDNLTFQKKIIERSGLGQNTYLPEAVLRVPPNPCMAEARKEAEMVMFGAIDELLEKTGVKPKDIGILVVNCSLFNPTPSLSAMVVNRYKLRGNILSYNLGGMGCSAGLISIDLAKQLLQVHPNSYALVVSMENITLNWYFGNDRSMLVSNCLFRLGGAAILLSNRSSDRRRAKYQLMHTVRTHKGADNKSYSCVFQREDDQTKIGVSLSKDLMAVAGEALKTNITTLGPIVLPMSEQLLFFITLVARKVFKMKIKPYIPDFKLAFEHFCIHAGGRAVLDEMEKNLELTDWHMEPSRMTLNRFGNTSSSSLWYELAYSEAKGRIRKGDRTWQIAFGSGFKCNSAVWKALRSVNPGKEKNPWMDEIDQFPVHVPKVSAVVSSK

SEQ ID NO: 15628 - protein, 365 aa, Glycine max
MPPVPISPIKVGHIDDVQELRKTKPRTIPQRFVRDMTERPTLTTPLPPPYSDMPVIDFYKLSKGNKEEVLTELFNLATACEEWGFFQVINHEIDLNLLESIENLSREFFMLPLEEKQKYPMAPGTVQGYGQAFVFSEDQKLDWCNMFALGIEPQYVRNPNLWPKKPEKFSETVEEYSGEIRKLCYNLLTYIALGLGLKGDEFEKMFGISVQAVRMNYYPPCSRPDLVLGLSPHSDGSALTVLQQAKGGPVGLQILKDNTWVPIQPIPNALVINIGDTIEVLTNGKYRSVEHRAVAHEEKDRLSIVTFFAPSYEVELGPMPEFVDENHPCKYKRYSHGEYSKHYVTNKLQGKKTLDFAKIQTKNKN

SEQ ID NO: 15629 - protein, 366 aa, Cajanus cajan
MPPVPITPIRVGHIDDVQELRKTKPRTIPQRFVRDMPERPTLTTTPLPPPHSHMPIIDFSKLSRGNKEEVLTEIFNLATACEDWGFFQVINHEVDLNLLHSIENLSREFFMLPLEEKQKYPMVPGTVQGYGQAFVFSEDQKLDWCNMFALGIEPQYVRNPNLWPKRPERFSETVEEYSGEIRKLCYNLLTYIALGLGLKGDVFEKMFGLSVQAIRMNYYPPCSRPDLVLGLSPHSDGSALTVLQQAKGGPVGLQILKDNTWVPIHPIPNALVINIGDTIEVLTNGKYRSVEHRAVAHEEKDRLSIVTFFAPSYDVELGPMQEFVDENHPCKFRRYNHGEYSKHYVTNKLQGKKTLDFAKIQTKNTN

SEQ ID NO: 15630 - protein, 365 aa, Glycine max
MPPVPISPIKVGHIDDVQELRKTKPRTIPQRFVRDLTERPTLTTPLPPPHSDMPVIDFSKLSKGNKEEVLTELFNLATACEEWGFFQVINHEIDLNLLESIENLSREFFMLPLEEKQKYPMAPGTVQGYGQAFVFSEDQKLDWCNMFALGIEPQYVRNPNLWPKKPEKFSETVEEYSGEIRKLCYNLLTYIALGLGLKGDEFEEMFGVSVQAVRMNYYPPCSRPDLVLGLSPHSDGSALTVLQQAKGGPVGLQILKDNTWVPIQPIPNALVINIGDTIEVLTNGKYRSVEHRAVAHEEKARLSIVTFFAPSYEVELGPMPEFVDENHPCKYKIYNHGEYSKHYVTNKLQGKKTLEFAKIQTKNTN

SEQ ID NO: 15631 - protein, 365 aa, Glycine max
MPPVPISPIKAGHIDDVQELRKTKPRTIPQRFVRDLTERPTLTTPLPPPHSDMPVIDFSKLSKGNKEEVLTELFNLATACEEWGFFQVINHEIDLNLLESIENLSREFFMLPLEEKQKYPMAPGTVQGYGQAFVFSEDQKLDWCNMFALGIEPQYVRNPNLWPKKPEKFSETVEEYSGEIRKLCYNLLTYIALGLGLKGDEFEEMFGVSVQAVRMNYYPPCSRPDLVLGLSPHSDGSALTVLQQAKGGPVGLQILKDNTWVPIQPIPNALVINIGDTIEVLTNGKYRSVEHRAVAHEEKARLSIVTFFAPSYEVELGPMPEFVDENHPCKYKIYNHGEYSKHYVTNKLQGKKTLEFAKIQTKNTN

SEQ ID NO: 15632 - protein, 366 aa, Lotus japonicus
MAPVPISTLNVGHIDDVQELRKTKPKTIPQRFVRDMTERPTLDDTALSSPQSDLPVIDFSKLSKGNKEEVLSELCKLAIACEEWGFFQVINHEIDLNLLESIENMSREFFMQPLEEKQKYPMAPGTVQGYGQAFVFSEDQKLDWCNMFALGIEPHYVRNPNLWPKKPARLSETIEEYSEGIRKLCQYLLEYIALGLGLKGDAFEKVFGAAVQAIRMNYYPPCSRPDLVLGLSPHSDGSALTVLQQAKGSPVGLQILKNSTWVPVQPIPNALVINIGDTLEVLTNGKYRSVEHRAVAHEEQDRLSIVTFYAPSYEVELGPMQEFFDENHPCKYRRYNHGEYSKHYVTNKLQGKKTLDFAKIQVENTN

SEQ ID NO: 15633 - protein, 365 aa, Lupinus angustifolius
MAPVPISLINVGHIDDVQELRKTKPKTIPQRFVRHMTERPTLVTSVSQHNSDMPVIDFSKLSKGNKEEVLTELFNLATACEEWGFFQVINHEVDLNLLESIEKISKDFFMLPLEEKQKYQMVPGTVQGYGQAFVFSEDQKLDWCNMFALGIEPNYMRSPNLWPKRPEKFSETVEVYSREVRKLCKNLLKYIGLGLELEGDAFEKIFGGAVQAMRMNYYPPCSRPDLVLGLSPHSDGSALTVLQQAKGSPVGLQILKDSKWVPVQPIPNALVINIGDTIEVLTNGKYKSVEHRAVANKEKDRLSIVTFYAPSYEVELGPMQEFIDENHPCKYRRYNHGEYSKHYVTNKLQGKKTLDFARIQTKNTK

SEQ ID NO: 15634 - protein, 366 aa, Cicer arietinum
MAPVPISTLNVGHIDDVQELRRTKPKTIPQRFVRNMTERPTLQTPLSPPNSDMPVIDFSKLSKGTKEEILNELYKLATACEEWGFFQVINHEIDLNLMENLEDLSREFFMLPLEEKQKYPMAPGTVQGYGQAFVFSEDQKLDWCNMFALGIEPHYVRNQNLWPKKPARLSETVELYSREIRKLCQNLLKYIAIGLSLEEDVFEKMFDEAVQAIRMNYYPPCSRPDLVLGLSPHSDGSALTVLQQAKGSPVGLQILKNNTWVPLQPIPNALVINIGDTIEVLTNGKYKSVEHRAVANEDKDRLSIVTFYAPSYEIEVGPMDEFVDEKHPCKFRRYNHGEYSKHYVTNKLQGKRALDFAKMEIMNNTN

SEQ ID NO: 15635 - protein, 443 aa, Gossypium raimondii
MAAYRLLIFSLFLALVFTKIGADASTEPLLESDAADSSALKMELDQLKSKIRLLESNVEEKIRELKTKDEMIKQKDKIIEEKSDSMASLHSELSSLQKKGTSDAEERVGKAHAKALELQKQVDKLKTELEAKLKDKDYLESRATKAENKLNELNLQLENLQKINKEQENKLAKTERALKIAEEELIKAKFEATSKANELMEVHSAWLPPWLATQLIRGQAFIQTHWNQHGKPNMDMVIQKALERKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQETLKKHELTRPLATKELEWFSASALLALPIIILFRIFSAIFCKKTKKRVRHTNAVHHGRRKGKRGHTDK

SEQ ID NO: 15636 - protein, 443 aa, Gossypium hirsutum
MAAYRLLIFSLFLALVFTKIGADASTEPLLESDAADSSALKMELDQLKSKIRLLESNVEEKIRELKTKDEMIKQKDKIIEEKSDSMASLRSELSSLQKKGTSDAEERVGKAHAKALELQKQVDKLKTELEAKLKDKDYLESRATKAENNLNELNLQLENLQKINKEQENKLAKTERALKIAEEELIKAKFEATSKANELMEVHSAWLPPWLATQLIRGQAFIQTHWNQHGKPNMDMVIQKALERKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQENLKKHELTRPLATKELEWFAASALLALPIIILFRIFSAIFCKKTKKRVRHTNATHHGRRKGKRGHTDK

SEQ ID NO: 15637 - protein, 100 aa, Gossypium hirsutum
MKPYTKEVVKAYGRFLESATTYHQQVQASVQETLKKHELTRPLATKELEWFSASALLALPIIILFRIFSAIFCKKTKKRVRHTNAVHHGRRKGKRGHTDK

SEQ ID NO: 15638 - protein, 445 aa, Theobroma cacao
MAASKLVIFSLFVALIFAQVRADASIEPVPESAGADSSARKIELDQLKAKIRLLESNDEEKTRELKTKDELIKQKEKIIQEKSDSIASLNTEISSLQKKGTSDAKEQVGKAHARALELQKQVDTLKSELEAKLKDKDSLEARATDAENKLTELNLKLENLQKINNKQKSKIAKTERALKVAEEELMKAKFEATSKTNELMEVHGAWLPPWLAVKLIHCQAFVQTHWNERGKPAMDMVIQKALEKKALAEKWAEPRMETIKTKWVPAVKDQWLVVTTYAEPHVQLLTAKTVEVYEVSKSAITPHIIKVQEIVDPYFQEAKKFSKPYIDQVATLAKPHVDKVRVVMKPYTKEVVNAYGKFLELATTYHHQVQASVREMLKKHELTRPLATKELEWFAASALLALPIIILFRICSAIFCKKAKKPVRHANTNQGRRKAKRGHPDKQTA

SEQ ID NO: 15639 - protein, 188 aa, Gossypium hirsutum
LILVAFSSLINISSAGRQIAPKTSIEFIRTSCSSTTYPKLCYESLLTQASMIQTSPQLIAHAALNVTLSTAKSTSALMVKLAKSQGLKPTEVGAMQDCVEELEDTIDELRKSISEMGQLKGSNFGLMINDIQTWVSAALTDENTCADGFGGKNMNGSVKTAVRSKIVTIAHLTSNALALVNSYASFHG

SEQ ID NO: 15640 - protein, 794 aa, Theobroma cacao
MNKIRSVPTSSTKSFNSIINNLSSQGSYHEVLVTYTTMLNSSTPDSYTFPSLLKACTSLNLFSIGLSVHQQVILRGFSSDSYTASSLINFYSKFGHTKHARKVFDKTLNRDVVPWTAIIGCYGRGGDVGNAFSMLNEMRYNGVEPSPVTFLSLLSGALEVAQVQALHGCAVLYGFESDIAVGNSLLNAYSKCGSIGEARGLFELMDQKDKISWNSLISGYAQLGNVEEILQLLYAMKIENMGPDQQTFGSLVTAVAAQSTLDIGRVVHGQILRSGFDSDAHIETALMVMYLKCGTTDAAYQIFEGVSQKDVVLWTAMISGLVQNNFADKALTVFYQMMKSRVEPSTATLTSALAACAQLGSFDLGTSIHAYILRHGLTIDIPVQNSLVTMYAKCGHLEQSCAVFERINKRDLVSWNAIISGCAQNDHLSKALFFFNKMRLTLQKPDSLTAVTLLQASASTGALHQGKWFHNFVIRSCLRPCILVDTALVDMYCKCGDLDAAVKCFRVMSQQDLISWSTIIAGYGSHGKGEMALNMYFEFLHSGMEPNKVIFLSVLSACSHNGLVDEGLSIFQSMARDFGIQPELEHRACIVDLLCRAGRVEEAYNFYKGNFSEPAVDVLSILLDACRANDNLELGDVIAQDVIRLRPASAANYVQIAHCYASMSRWNSVGEAWSQMRSLGLRKLPGWSFIDLHGTVTSFLSGQNAHPKHEEIVATLKTLSWEMSEVCMNFKMHQILDIFLETQSILNASECIHLVKTEQQQDSRTQLFNFREQGENREMKMTLEHNKSGDNGKG

SEQ ID NO: 15641 - protein, 245 aa, Theobroma cacao
MAASSAAMDGVAAAAIRSVLQRVHQAAERSGRESQRIRVVAVSKTKPVSILRQVYDAGHRCFGENYVQELVEKAPQLPGDTEWHFVGNLQSNKVKPLIAGVPNLAMVETVDDEKIANHLNRVVGSFERKPLKVLVQVNTSGEESKSGVEPSGCVELVKHVSLNCPNLQFCGLMTIGMLDYTSTPENFMTLANCRSEVCKALGIPEEQCELSMGMSGDFEQAIEMGSTNVRIGSTIFGAREYPKKT

SEQ ID NO: 15642 - protein, 180 aa, Unknown
  Sequence found in Organisms: Gossypium hirsutum, Gossypium raimondii
MENPQHPEGKEACESNPTNVKRVSDDIMPHLLNLYGSRATPRDFEIYAADASFEDPLMCAHGVKQIKSSFYSLSKVFSESRIVEYSITEKEISAGKHEVLVDNKQQYKFLGRNIDMISLIRLYVKDGKVVRHEDWWDKKPLRNRETVKLPCVGRMIELTRRGSMFVTHALMGFGKDPPTG

SEQ ID NO: 15643 - protein, 180 aa, Gossypium hirsutum
MENPQHPEGKEACESNPTNVKRVSDDIMPHLLNLYGSHATPRDFEIYAADASFEDPLMCAHGVKQIKSSFYSLSKVFSESRIVEYSITEKEISAGKHEVLVDNKQQYKFLGRNIDMISLIRLDVKDGKVVRHEDWWDKKPLRNRETVKLPCVGRMIELTRRGSMFVTHALMGFGKDPPTG

SEQ ID NO: 15644 - protein, 1137 aa, Trigonella foenum-graecum
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANSPLLGSLPKAAGGFPPLGAHGPFQPNPAAVPTQLAGWMSNPTTVAHAAVSGAGAIGLGAPSMPGALKHPRTPPINPSVDYPSGDSDHVAKRTRPMGITDEVNLPVNVLSGTFPGHGHSQAFNAPDDLPIPKTVMRTLNQGSSPMSMDFHPVQQSLLLVGTNVGDIALWEVGSRERLVSRNFKVWDLSACTMPFQAALVKDPSVSVNRVIWSPDGALFGVAYSRHIVQIYSYHGSDEVRQHLEIDAHVGGVNDLAFSHPNKQLCVITCGDDKTIKVWDAATGTKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSMGVVQFDTTKNRFLAAGDDFSIKFWDMDNIQLMTTVDADGGLPASPRIRFNKDGTLLAVSANDNGIKIIANADGIRLLRTLENSMYDASRASELAKPTINSMSSAAAATSAALAERASSVAAITGMNGDSRNMADVKPRISEESNDKSKIWKLTEINEPSHCRSLKLPENVRVNKISRLIYTNSGNAILALASNAIHLLWKWPRNERNSTGKANASVQAQLWQPSSGILMTNDTADSNPEDSVPCFALSKNDSYVMSASGGKISLFNMMTFKTMTTFMPAPPAATFLAFHPQDNNIIAIGMDDSSIQIYNVRVDEVKSKLKGHTKRITGLAFSHVLNVLVSSGADAQICVWNTDGWEKQKTRFLQLPPGRTPSAQSDTRVQFHQDQIQFLVVHETQLAIFEATKLECLKQWAPRDSSAPISHATFSCDSQLIYASFLDATVCVFNASNLRLRCRITPSAYLPASVSNSNVQPLVITAHPHEPNQFAVGLSDGGVHVFEPLESEGKWGVPPPNENGSSSNNVAVATSVGLSSDQAQT

SEQ ID NO: 15645 - protein, 1134 aa, Cicer arietinum
MSSLSRELVFLILQFLDEEKFKETVHKLEQESGFFFNMKYFEEEVHNGNWDEVEKYLSGFTKVDDNRYSMKIFFEIRKQKYLEALDKHDRSKAVEILVKDLKVFSTFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQQPNGARAPSPANSPLLGSLPKAGGFPPLGAHGPFQPTPAPVPTPIAGWMPNPTTIAHAAVSGGGAIGLGALKHPRTPPTNPSADYPSGDSDHVAKRTRPMGITDEVNLPVNVLSPTFQGHGHGHGQSFNAPDDLPLPKTVMRTLNQGSSPMSMDFHPVQQSLLLVGTNVGDIALWEVGSRERLVSRNFKVWDLSACSMPFQASLVKEPSVSVNRVIWSPDGALFGVAYSRHIVQIYSYHGGYEVRQHLEIDAHVGGVNDLAFSHPNKQLCVITCGDDKTIKVWDAASGAKQYTFEGHEAPVYSVCPHYKESIQFIFSTALDGKIKAWLYDNLGSRVDYDAPGRWRTTMAYSADGTRLFSCGTSKDGESSIVEWNESEGAVKRTYQGFRKQSLGVVQFDTTKNRFLAAGDDFSIKFWDMDNIQLLTTVDADGGLAASPRIRFNKDGTLLAVSSNDNGIKILANADGIRLLRTLENSIYDASRASEALAKPTINSISSASAATSAALAERASSAAAIAGMNGDARNMGDVKPRISEESNDKSKIWKLTEINEPSHCRSLKLPENVRVNKISRLIYTNSGNAILALASNAIHLLWKWPRNERNSSGKANASVQPQLWQPSSGILMTNDIADSNPEDSVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKTRFLQLPPGRTPSAQSDTRVQFHQDQIQFLVVHETQLAIFEATKLECLKQWFPRDSSAPISHATFSCDSQLIYASFLDATVCVFNASNLRLRCRISPSAYLPSSVSNSNVQPLVIAAHPQEPNQFAIGLSDGGVHVFEPLESEGKWGVPPPVENGSTSNNVAVATSVGLPSDQAQR

SEQ ID NO: 15646 - protein, 1133 aa, Glycine max
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGALPKAGGFPPLGAHGPFQPTPAPVPTPLAGWMSNPTTVAHAAVSGGGAIGLGAPSMPAALKHPRTPPTNPSVDYPSGDSDHVAKRTRPMGISDEVNLPVNVLSATFPGHGQHSQAFNAPDDIPKTVVRTLNQGSSPMSMDFHPMQQSLLLVGTHVGDIALWEVGSRERLVSRNFKVWDLSACSMPFQAALVKDPGVSVNRVIWSPDGALFGVAYSRHIVQIYSYHGGDEIRQHLEIDAHVGGVNDLAFSHPNKQLCVITCGDDKTIKVWDAASGAKQYTFEGHEAPVYSVCPHYKENIQFIFSTALDGKIKAWLYDNLGSRVDYEAPGRWCTTMAYSADGTRLFSCGTSKDGESSIVEWNESEGAVKRTYQGFRKRSLGVVQFDTTKNRFLAAGDDFSIKFWDMDNVQLLTTVDADGGLPASPRIRFNKDGTLLAVSANENGIKILANGDGIRLLRTLENSLYEASRASEALTKPTINPISAAAAAATSAALAERASSVVAIAGMNGDTRNLGDVKPRISEESNDKSKIWKLTEINEQSQCRSLKLPENVRVTKISRLIYTNSGNAILALASNAIHLLWKWQRNERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPPGRTPPAQSDTRVQFHQDQIQFLVVHETQLAIYEATKLEGLKQWFPRDSSAPISYATFSCDSQLVFASFLDATICVFSASNLRLRCRINPSSYLPASVSSNIQPLVIAAHPQEPNQFALGLSDGGVHVFEPLESEGKWGVPPPIENGSASNVAATSVGPSDQAQR

SEQ ID NO: 15647 - protein, 1137 aa, Phaseolus vulgaris
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGALPKAGGFPPLGAHGPFQPTPAPVPTPLAGWMSNPTTVAHAAVSGGGAIGLGAPSMPAALKHPRTPPTNPSDYPSGDSEHVAKRTRPIGISDEVNLPVNVLSATFPGHGQHSQAFNAPDDIPKAVVRTLNQGSSPMSMDFHPVQQSLLLVGTNVGDIALWEVGSRERLVSRNFKVWDLSACSMPFQAALVKDPGVSVNRVIWSPDGALFGVAYSRHIVQIYSYQGGDEIRHHLEIDAHVGGVNDLAFSHPNKQLCVITCGDDKTIRVWDAASGAKQYTFEGHEAPVYSVCPHHKENIQFIFSTALDGKIKAWLYDNLGSRVDYEAPGRWCTTMAYSADGTRLFSCGTSKDGESSIVEWNESEGAVKRTYQGFRKRSLGVVQFDTTKNRFLAAGDDFSIKFWDMDNVQLLTTVDADGGLPASPRIRFNKDGTLLAVSANENGIKILANGDGIRLLRTLENSLYDASRASEALTKPTINPISAAAAAAAAAATSAALAERASSVVAIAGMNGDTRNMGDVKPRISEESNDKSKVWKLTEINEQSQCRSLKLPENVRVTKISRLIYTNSGNAILALASNAIHLLWKWQRNERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPPGRTPPAQSDTRVQFHQDQIQFLVVHETQLAIYEATKLEGLKQWCPRDSSAPISHATFSCDSQLIYASFLDATICVFSASNLRLRCRINPSAYLPASVSSNVQPLVIAAHPQEPNQFAVGLSDGGVHVFEPLESEGKWGVPPPIENGSASNVAATSVGPSSDQAQR

SEQ ID NO: 15648 - protein, 1132 aa, Glycine max
MSSLSRELVFLILQFLDEEKFKETVHKLEQESGFFFNMKYFEDEVHNGNWDEVERYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPTPLAGWMSNPTTVAHPAVSGGAIGLGAPSIPAALKHPRTPPTNPSVDYPSGDSDHVSKRTRPIGMSDEVNLPVNVLSATFPGHGHGQAFNAPDDLPKTAMRSLNQGSSPMSMDFHPVQQTLLLVGTNVGDIALWEVGSRERLLMRNFKVWDLSACSMPFQAALVKDPGVSVNRVIWSPDGALFGVAYSRHIVQIYSYHGGDDVGQHLEIDAHVGGVNDLAFSHPNKQLCVITCGDDKTIKVWDAATGAKQYTFEGHEAPVYSICPHYKENIQFIFSTALDGKIKAWLYDNLGSRVDYEAPGRWCTTMAYSADGTRLFSCGTSKEGESSIVEWNESEGAVKRTYQGFRKRSLGVVQFDTTKNRYLAAGDDFSIKFWDMDNIQLLTTVDADGGLPASPRIRFNKDGALLAVSANENGIKILANADGIRLLRTLENSLYDTSRTSEAMTKPTINPISAAAAAATSAALAERASSVVAITAMNGDARNLGDVKPRISEESNDKSKIWKLTEINEPSQCRSLKLPENVRVNKISRLIYTNSGNAILALASNAIHLLWKWQRNDRNSTGKATASVQPQLWQPSSGILMTNDITDNNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPAGRTPPAQADTRVQFHQDQIRFLVVHETQLAIYEATKLECLKQWFPRDSSAPISHATFSCDSQLIYASFLDATVCVLSVSNLRLRCRINPSAYLSASVSSNVQPLVIAAHPQEPNQFAVGLSDGGVHVFEPHESEGKWGVPPPIENGSTSNMAATSVGASSDEAQR

SEQ ID NO: 15649 - protein, 1132 aa, Phaseolus vulgaris
MSSLSRELVFLILQFLDEEKFKETVHKLEQESGFFFNMKYFEDEVHNGNWDEVERYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPASNPLLGSLPKAGGFPPLGAHGPFQPTPAPVPTPLAGWMSNPTTVAHPAVSGGAIGLGAPSIPAALKHPRTPPTNPSVDYPSGDSDHVSKRTRPMGISDEVNLPVNVLSATFPGHGHGQAFNAPDDLPKTVMRTLNQGSSPMSMDFHPVQQTLLLVGTNVGDIALWEVGSRERLLMRNFKVWDLSACSMPFQAALVKDPGVSVNRVIWSPDGALFGVAYSRHIVQIYSYHGGDEARQHLEIDAHVGGVNDLAFSHPNKQLCVITCGDDKTIKVWDAASGAKQYTFEGHEAPVYSVCPHYKENIQFIFSTALDGKIKAWLYDNLGSRVDYEAPGRWCTTMAYSADGTRLFSCGTSKEGESSIVEWNESEGAVKRTYQGFRKRSLGVVQFDTTKNRYLAAGDDFSIKFWDMDNIQLLTTVDADGGLPASPRIRFNKDGALLAVSANENGIKILANGDGIRLLRTLENSLYDTSRTSEAMTKPAINPISAAAAAAATSAALAERASSVAITAMNGDARNMGDVKPRISEESNDKSKIWKLTEINEQSQCRSLKLPENVRVNKISRLIYTNSGNAILALASNAIHLLWKWQRSDRNSTGKASATVQPQLWQPSSGILMTNDLTDSNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQLCVWNTDGWEKQKSRFLQLPAGRTPPAQADTRVQFHQDQIRFLVVHETQLAIYEATKLECLKQWFPRESAAPVSHATFSCDSQLIYASFLDATVCVFSASNLRLRCRINPSAYLSASVSSNVQPLVIAAHPQEPNQFAVGLSDGGVHVFEPLESEGKWGVPPPNENGSTSNMAATSVGASSDEAQR

SEQ ID NO: 15650 - protein, 1135 aa, Lotus japonicus
MSSLSRELVFLILQFLDEEKFKETVHKLEQESGFFFNMKYFEDEVHNGNWEEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANSPLLGSLPKAGGFPPLGAHGPFQPTPAQVPTPLAGWMSNPTPVTHAAVSGGGGIGLGAPSIPAVLKHPRTPPTNPSVDYPSGDSDHVAKRPRPMGISDEVNLPVNVLSASFSGHGHGHGQAFSAPDDLPKTVVRTLNQGSTPMSMDFHPVQQTLLLVGTNVGDIALWEVGSRDRLVSRNFKVWDLSACSMTFQAALVKDPGVSVNRVIWSPDGALFGVAYSRHIVQIYSYHGGDEVRQHLEIDAHVGGVNDLAFSHPNKQLCVITCGDDKTIKVWDAASGAKQYTFEGHEAPVYSVCPHYKENIQFIFSTALDGKIKAWLYDNLGSRVDYDAPGRWCTTMAYSADGTRLFSCGTSKEGESSIVEWNESEGAVKRTYQGFRKRSMGVVQFDTTKNRFLAAGDDFSIKFWDMDNVQLLTTVDADGGLAASPRIRFNKDGTLLAVSANENGIKILANGDGNRLLRTLENSIYDASRTSEALAKPTINPISAAAAAATSAALAERASSVVAITGMNGDPRNLGDVKPRISEESNDKSKIWKLTEINEPSQCRTLKLVENPRVNKISRLIYTNSGNAILALASNAIHLLWKWQRTDRSSSGKANATVQPQLWQPSSGILMTNDIADGNPEEALACFALSKNDSYVMSASGGKVSLFNMMTFKTMTTFMPPPPAATFLAFHPQDNNIIAIGMDDSSIQIYNVRVDEVKSKLKGHTKKITGLAFSHVLNVLVSSGADNQICVWNTNGWEKQKTRFLQLPHGRTPPAQSDTRVQFHQDQIHFLVVHETQLAIYEATKLEGLKQWFPQDSAAPISHATFSCDSQLIYASFLDATICVFSASNLRLRCRINPSAYLPSSVSSNVQPLVIAAHPQEPNQFATGLSDGTVHVFEPLESDGKWGVPPPIENGSASNVAAASGGPSSEQAQR

SEQ ID NO: 15651 - protein, 1136 aa, Glycine max
MSSLSRELVFLILQFLDEEKFKETVHKLEQESGFFFNMKYFEDEVHNGNWDEVERYLSGFTKVDDNRYSMKIFFEVMKQKYLEALDKHDRSKAVEILVKDLKVFATFNDELFKEITQLLTLENFRENEQLSKYCDTKSARAIMLVELKKLIEANPLFHDKLQFPNLKSSRLRTLINQSLNWQHQLCKNPRPNPDIKTLFVDHSCGQLNGAPAPSPANNLLLGSLPKAGGFPPLGAHGPFQPSPAPVPTPLAGWMSNPTTVAHPEVSGGAIGLGVPSIPAALKHPRTPPTYPSVDYPSGDSDHVSKRTRPMGMSDEVNLPVNVLSATFPGHGHGHGHGQAFNAPDDLPKTAMRTLNQGSSPMSMDFHPVQQTLLLVGTNVGDIALWEVGSRERLLMRNFKVWDLSACSMPFQAALVKDPGVSVYRVIWSPDGALFGVAYSRHIVQIYSYHSGDDVQQHLEIDAHVGGVNDLAFSHPNKQLCVITCGDDKTIKVWDAATGAKQYTFEGHEAPVYSVCPHYKENIQFIFSTALDGKIKAWLYDNLGSRVDYEAPGRWCTTMAYSADGTRLFSCGTSKDAESSIVEWNESEGAVKRTYQGFRKRSLGFVQFDTTKNRYLAAGDDFSIKFWDMDNIQLLTTVDADGGLPGSPRIRFNKDGALLAVSAKENGIKILANADGIRLLRTLENSLYDTSRTSEVMTKPTINPISAAAAAATSAALGERALSVVGINAMNGDARNLGDVKPRISEESNDKSKIWKLTEINEPSQCRSLKLPENVRVNKISRLIYTNSGNAILALASNAIHLLWKWQRNDRNSTVKASASVQPQLWQPSSGILMTNDITDSNTEDAVPCFALSKNDSYVMSASGGKISLFNMMTFKTMTTFMPPPPAANFLAFHPQDNNIIAIGMDDSSIQIYNVRVDEVKSKLKGHTKRITGLAFSHVLNVLVSSGADAQICVWNTDGWEKQKSRFLQLPAGRTPPAQADTRVQFHQDQIRFLVVHETQLAIYEATKLECLKQWFPRDSSAPISHATFSCDSQLIYASFLDATVCVFSVSNLRLQCRINPSAYLSASVSSNVQPLVIAAHPQEPNQFAVGLSDGGVHVFEPLESEGKWGVPPPIENGSTSNMAATSVGASSDEAQR

SEQ ID NO: 15652 - protein, 1133 aa, Medicago truncatula
MSSLSRELVFLILQFLEEEKFKEAVHKLEQESGFYFNMKYFEEEVHNGNWDEVEKYLSGFTKVDDNRYSMKIFFEIRKQKYLEALDKHDRSKGVEILVKDLKVFSTFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANMPLLGSLPKVGGFPPLGAHGPFQPTPAPVPMPLAGWMSNPTTVAHPSVSGGGAIGLGVGGPSMPAALKHPRTPPTNPSVDYPSGDSDHISKRTRPIGMSDEGNLPVNVLSATFPGHGHGQAFNSPDDLPKTVLRTLNQGSSPMSMDFHPVQQTLLLVGTNVADIGLWELGSRERLVLRNFKVWDLSACSMPFQAALVKDPAVSVNRVTWSPDGALFGVAYSRHIVQIYSYHGGDEVRQHLEIDAHVGGVNDLAFSHPNKQLCVITCGDDKTIKVWDAATGLKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSLGVVQFDTTKNRYLAAGDDFSIKFWDMDNIQLLTTVDADGGLPASPRIRFNKEGSLLAVSANENGIKILANGDGVRLLRSLENSSYDASRTPETMTKPIINPMSVATAATSAALERASSVAAITGMNGDVRNLGDIKPRISEESNDKSKIWKLTEINEPSHCRSLKLPENARVTKISRLIYTNSGNAILALASNAIHLLWKWQRNDRNSSGKATASVPPQLWQPSSGILMTNDINDNNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADGQIFVWNTDGWEKQKNRFLQFPAGRTPPAQADTRVQFHQDQFRFLVVHETQLAIYEATKLECLKQWFPRDAAAPISHATFSCDSNLIFASFLDATICVFSASNLRLRCRINPSAYLSANVSSNIQPLVIAAHPHEPNQFAVGLSDGIVHVFEPLESEGKWGVPPPIENGSASNAVANSVGASSDEVQR

SEQ ID NO: 15653 - protein, 1133 aa, Medicago truncatula
MSSLSRELVFLILQFLEEEKFKEAVHKLEQESGFYFNMKYFEEEVHNGNWDEVEKYLSGFTKVDDNRYSMKIFFEIRKQKYLEALDKHDRSKGVEILVKDLKVFSTFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANMPLLGSLPKVGGFPPLGAHGPFQPTPAPVPMPLAGWMSNPTPVAHPSVSGGGAIGLGVGGPSMPAALKHPRTPPTNPSVDYPSGDSDHISKRTRPIGMSDEGNLPVNVLSATFPGHGHGQAFNSPDDLPKTVLRTLNQGSSPMSMDFHPVQQTLLLVGTNVADIGLWELGSRERLVLRNFKVWDLSACSMPFQAALVKDPAVSVNRVTWSPDGALFGVAYSRHIVQIYSYHGGDEVRQHLEIDAHVGGVNDLAFSHPNKQLCVITCGDDKTIKVWDAATGLKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSLGVVQFDTTKNRYLAAGDDFSIKFWDMDNIQLLTTVDADGGLPASPRIRFNKEGSLLAVSANENGIKILANGDGIRLLRSLENSSYDASRTSEAMTKPIINPMSVATAATSAALERASSVAAITGMNGDVRNLGDIKPRISEESNDKSKIWKLTEINEPSHCRSLKLPENARVTKISRLIYTNSGNAILALASNAIHLLWKWQRNDRNSSGKATASVPPQLWQPSSGILMTNDINDNNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADGQIFVWNTDGWEKQKNRFLQFPAGRTPPAQADTRVQFHQDQFRFLVVHETQLAIYEATKLECLKQWFPRDAAAPISHATFSCDSNLIFASFLDATICVFSASNLRLRCRINPSAYLSANVSSNIQPLVIAAHPHEPNQFAVGLSDGIVHVFEPLESEGKWGVPPPIENGSASNAVANSVGASSDEVQR

SEQ ID NO: 15654 - protein, 194 aa, Quercus alba
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNQGQIQI

SEQ ID NO: 15655 - protein, 1132 aa, Lupinus angustifolius
MSYLSRELVFLILQFLDEEKFKETVHKLEQESGFFFNIKYFEDEVHNGNWDEVERYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKSSRLRTLINQSLNWQHQLCKNPRPNPDIKTLFVDHSCGQPNGAQAPSPAYSPLLGSLPKAGGFPSLGAHGPFQPTPAPLPTPLAGWMSNPTTVAHPAVSGGGAIGLAALKNTRVPPTNPSVDYTSGDSVHVSKKTRPMGLSDEVNLPVNVLSSTFQGHDHGHGHSFNASDDLPKTVMRTLNQGSSPMSMDFHPVQQTLLLVGTNVGDIALWEVGTRERLVLRNFKVWELGSCSMQFQAALVKDPCVSVNRVIWSPDGALFGVAYSRHIVQIHSYHGADEVRQHLEIDAHVGGVNDLAFSHPNKKLCVITCGDDKTIKVWDTATGTKQYTFEGHDAPVYSVCPHYKENIQFIFSTALDGKIKAWLYDNLGSRVDYDAPGRWCTTMAYSADGTRLFSCGTSKDGESSIVEWNESEGAVKRTYQGFRKRSLGVVQFDTTKNRYLAAGDDFSIKFWDMDNIQLLTTVDADGGLPASPRIRFNKDGALLAVSANENGIKILANGDGIHLLRSLENSLYDASRTSEAMAKPTINPISAAAAAAAASSAALAERTSSVAAIAGMNGDARTLVDVKPRISGESSDKSKIWKLTEISEPSQCRSLKLPENARVTKISRLIYTNSGNAILALASNAIHLLWKWQRSDRNSSGKANASMSPQLWQPSSGILMTNDINDNTTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQLCVWNTNGWEKQTTRFLQLPAGRTPPAQADTRVQFHQDQIHFLVVHETQLAIYEATKLECLKQWSPRDSAAPISHATFSCDSQLIYASFLDTTVCVFSASNLILRCRINPSAYLSASVSNSNVQPLVIAAHPHEPNQFAVGLSDGAVHVFEPLESEGKWGVPPPIENGSASNVAATSVGPSSDEAQR

SEQ ID NO: 15656 - protein, 1120 aa, Glycine max
MSSLSRELVFLILQFLDEEKFKETVHKLEQESGFFFNMKYFEDEVHNGNWDEVERYLSGFTKVDDNRYSMKIFFEVMKQKYLEALDKHDRSKAVEILVKDLKVFATFNDELFKEITQLLTLENFRENEQLSKYCDTKSARAIMLVELKKLIEANPLFHDKLQFPNLKSSRLRTLINQSLNWQHQLCKNPRPNPDIKTLFVDHSCGQLNGAPAPSPANNLLLGSLPKAGGFPPLGAHGPFQPSPAPVPTPLAGWMSNPTTVAHPEVSGGAIGLGVPSIPAALKHPRTPPTYPSVDYPSGDSDHVSKRTRPMGMSDEVNLPVNVLSATFPGHGHGHGHGQAFNAPDDLPKTAMRTLNQGSSPMSMDFHPVQQTLLLVGTNVGDIALWEVGSRERLLMRNFKVWDLSACSMPFQAALVKDPGVSVYRVIWSPDGALFGVAYSRHIVQIYSYHSGDDVQQHLEIDAHVGGVNDLAFSHPNKQLCVITCGDDKTIKVWDAATGAKQYTFEGHEAPVYSFIFSTALDGKIKAWLYDNLGSRVDYEAPGRWCTTMAYSADGTRLFSCGTSKDAESSIVEWNESEGAVKRTYQGFRKRSLGFVQFDTTKNRYLAAGDDFSIKFWDMDNIQLLTTVDADGGLPGSPRIRFNKDGALLAVSAKENGIKILANADGIRLLRTLENSLYDTSRTSEVMTKPTINPISAAAAAATSAALGERALSVNGDARNLGDVKPRISEESNDKSKIWKLTEINEPSQCRSLKLPENVRVNKISRLIYTNSGNAILALASNAIHLLWKWQRNDRNSTVKASASVQPQLWQPSSGILMTNDITDSNTEDAVPCFALSKNDSYVMSASGGKISLFNMMTFKTMTTFMPPPPAANFLAFHPQDNNIIAIGMDDSSIQIYNVRVDEVKSKLKGHTKRITGLAFSHVLNVLVSSGADAQICVWNTDGWEKQKSRFLQLPAGRTPPAQADTRVQFHQDQIRFLVVHETQLAIYEATKLECLKQWFPRDSSAPISHATFSCDSQLIYASFLDATVCVFSVSNLRLQCRINPSAYLSASVSSNVQPLVIAAHPQEPNQFAVGLSDGGVHVFEPLESEGKWGVPPPIENGSTSNMAATSVGASSDEAQR

SEQ ID NO: 15657 - protein, 1133 aa, Castanea mollissima
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPNLGAHGPFQPTPAPVPTPLAGWMSNPSTVTHPAVSGGAIGLGAPSIPAALKHPRTPPTNPSVDYPSGDSDHVSKRTRPMGISDEVNLPVNVLPVTFPGHGHGQAFNATDDLPKNVARTLNQGSSPMSMDFHPIQQTLLLVGTNVGDIALWEVGSRERLVLRNFKVWDLSVCSMPLQAALVKDPGVSVNRVIWSPDGSLFGVAYSRHIVQIYSYHGNEDVRQHLEIDAHVGGVNDIAFSHPNKQLCVITCGDDKTIKVWDAATGAKQYTFEGHEAPVYSVCPHYKENIQFIFSTALDGKIKAWLYDNLGSRVDYDAPGRWCTTMAYSADGTRLFSCGTSKDGESFIVEWNESEGAVKRTYQGFRKRSLGVVQFDTTKNRFLAAGDDFSIKFWDMDNVQLLVTIDADGGLPASPRIRFNKDGSLLAISANDNGIKILSNTDGIRLLRTFENLSYDASRASESVAKPTINPISAAAAAATSAGLADRGASVVAIAGMNGDARNLGDVKPRIMEESNDKSKILKLTEINEPSQCRSLRLPENLRVTKISRLIYTNSGNAVLALASNAIHLLWKWQRSDRNSSGKATASLSPNLWQPPSGILMTNDIADTNPEDSVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSEGWEKQKARLLQLPTGRTPAQSDTRVQFHQDQMHFLVVHETQLAIYETTKLECVKQWLSRESAPISHATFSCDSLLVYACFLDGTVCVFNAANLRLRCRINPSAYLPANVSSSSVQPLVIAAHPQEPNQFAIGLSDGGVHVFEPLESEGKWGVLPPVENGSASSVPATPSVGASGSDQAQR

SEQ ID NO: 15658 - protein, 880 aa, Ricinus communis
MSNPSAVTHPAVSGGGAIGLGAPSIPAALKHPRTPPTNPSVDYPSGDSDHVAKRTRPMGISDEVNLPVNVLPVSFPGHGHGQNFNAPDDLPKTVSRTLNQGSSPMSMDFHPLEQTLLLVGTNVGDVALWEVGSRERLMLRNFKVWDISTCSMPLQAALVKDPGVSVNRVIWSPDGSLFGVAYSRHIVQIYSYHRGDDVRQHLEIDAHVGGVNDLAFSTPNKQLCVITCGDDKTIKVWDAATGTRQYTFEGHEAPVYSVCPHYKENIQFIFSTALDGKIKAWLYDNLGSRVDYEAPGRWCTTMAYSADGTRLFSCGTSKDGESHIVEWNESEGNVKRSYQGFRKRSLGVVQFDTTKNRFLAAGDDFSIKFWDMDNLQLLTSIDADGGLPASPRIRFNKDGSLLAVSANENGIKILANSDGHRLLRTFENLSYDASRASEAVTKPIINPISAAAATSAGLADRTASVVTIPGMNGDARNMGDVKPRITEESNDKSKIWKLTEINEPTQCRSLRLPDNLRVNKISRLIYTNSGNAILALASNAIHLLWKWQRSERNSTGKATANVSPQLWQPSSGILMTNDITDTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKTRFLQVPPGRTTTGQSDTRVQFHQDQIQFLVVHETQLAIYEATKLECTKQWVTRESSAPISHATFSCDSQLVYASFLDATVCVFSAQNLRLRCRINPSSYLSANVSSSLHPLVIAAHPQEPNQFALGLSDGGVHVFEPLESEGKWGVPPPAENGSASSVPATPSVGPSGSDQAQR

SEQ ID NO: 15659 - protein, 1136 aa, Manihot esculenta
MSSLSRELVFLILQFLDEEKFKETVHKLEQESGFFFNMKYFEDEVHSGNWDEVEKYLSGFTKVDDNRYSMKIFFEIRKQKYLEALDKHDRSKAVDILVKDLKVFSTFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPAPLAGWMSNPSSVTHPAVSGGGAIGLGAPSIPAALKHPRTPPTNTSVDYPSGDSDHVAKRTRPMGISDEVNLPVNVLPVSFPGHGHGQTFNAPDDLPKTVARTLNQGSSPMSMDFHPVQQTLLLVGTNVGDVGLWEVGSRERLVLRNFKVWDLSTCSMPLQAALVKDPGVSVNRVIWSPDGNLFGVAYSRHIVQIYSYHGGDDVRQHLEIDAHVGGVNDLAFSTPNKQLCVITCGDDKTIKVWDAATGSKQHTFEGHEAPVYSVCPHYKENIQFIFSTALDGKIKAWLYDNLGSRVDYEAPGRWCTTMAYSADGTRLFSCGTSKEGESHIVEWNESEGNVKRSYQGFRKRSLGVVQFDTTKNRFLAAGDDFSIKFWDMDNVQILTSIDADGGLPASPRIRFNKDGTLLAVSANENGIKILANSDGLRLLRSFENLSYDASRASETVTKPIITPISAAAAAAATSAGLADRSVSVVNIPGMNGDARNLGDVKPRITEESNDKSKIWKLTEINEPSQCRSLRLPENLRVNKISRLIYTNSGNAILALASNAIHLLWKWQRSDRNSTGKATASVSPQLWQPSSGILMTNDITDTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKTRFLQVPPGRTTTGQSETRVQFHQDQIQFLVVHETQLAIYEATKLECAKQWVTRESSAPISHATFSCDSQLVYASFFDATVCVFSAQNLRLRCRISPSSYLPANVSSNVHPLVIAAHPQESNQFALGLSDGGVHVFEPLESEGKWGVPPPAENGSASSVPAASSVGPSGSDQAQR

SEQ ID NO: 15660 - protein, 1140 aa, Manihot esculenta
MSSLSRELVFLILQFLDEEKFKETVHKLEQESGFFFNMKYFEDEVHSGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPAPLAGWMSNPSTVTHPAVSGGGAIGLGAPSIAAALKHPRTPPTNPSVDYPSGDSDHVAKRTRPMGISDEVNLPVNVLPVSFPGHGHGHGQTFNAPDDLPKTLSRTLNQGSSPMSMDFHPVQQTILLVGTNVGDVGLWEVGSRERLVLRNFKVWDLSTCSMPLQAALVKDPGVSVNRVIWSPDGSLFGVAYSRHIVQIYSYHGGDDVRQHLEIDAHVGGVNDLAFSTPHKQLCVITCGDDKTIKVWDAGTGSKQYTFEGHEAPVYSVCPHYKENIQFIFSTALDGKIKAWLYDNLGSRVDYEAPGRWCTTMAYSADGTRLFSCGTSKEGESHIVEWNESEGNVKRSYQGFRKRSLGVVQFDTTKNRFLAAGDDFSIKFWDMDNVQLLTSIDADGGLPASPRIRFNKDGTLLAVSANDNGIKILANSDGLRLLRSFENLSYDASRASETVTKPIINPISAAAAAAAATSAGLADRNASVVTIPGMNGDARNMGDVKPRINEESNDKSKIWKLTEINEQSQCRSLRLPENLRVNKISRLIYTNSGNAILALASNAIHLLWKWQRSDRNSTGKATASMSPQLWQPSSGILMTNDFTDTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKTRFLQVPPGRTTTGQSDTRVQFHQDQIQFLVVHDTQLAMYEATKLECTKQWVTRESSAPISHATFSCDSQLVYASFLDATVCVFSAQNLRLRCRINPSSYLPANVSISNVHPLVIAAHPQESNQFALGLSDGGVHVFEPLESEGKWGVPPPAENGSASSVPAAPSVGPSGSEQAQR

SEQ ID NO: 15661 - protein, 1138 aa, Populus trichocarpa
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFSTFNEELFKEITQLLTLENFRENEQLSKYGDTKSARAIMLVELKKLIEANPLFRDKLQFPNLKNSRLRTLINQSLNWQHQLCKTPRSNPDIKTLFFDHSCGQPNGARAPSPANNPLLGSLPKAGGFPPLGAHGPFQPTPAPVPAPLAGWMSNPPTVTHPAVSGGGAIGLGAPSISAALKHPRTPPSNPSVDYPSGDPDHVAKRTRPMGISDEVNLPVNVLPMSFPGHGHGHGQTFNAPDDLPKAVVRTLNQGSSPMSMDFHPVQQTILLVGTNVGEIGLWEVGSRERLVLRNFKVWDLNACSMPLQAALVKDPGVSVNRVIWSPDGNLFGVAYSRHIVQIYSYHGNDDVRQHLEIDAHVGGVNDLAFSTPNKQLCVITCGDDKIIKVWDAATGAKQYTFEGHEAPVYSICPHYKENIQFIFSTALDGKIKAWLYDNLGSRVDYEAPGRWCTTMAYSADGTRLFSCGTSKDGESYIVEWNESEGAVKRTYVGFRKHSLGVVQFDTTKNRFLAAGDDFSIKFWDMDSVQLLTTIDADGGLPASPRIRFNKEGTLLAVSANDNGIKILANSDGIRLLRTFENLSYDASRASESVAKPTVNPISAAAAAAATSSGLADRGASVVAVAGMNGDARNLGDVKPRIAEELNDKSKIWKLTEINEPSQCRSLRLPENLRVTKISRLIYTNSGNAILALASNAIHLLWKWQRSDRNASGKATAGVPPQLWQPSSGILMTNDITDSNPEEAVACFALSKNDSYVMSASGGKISLFNMMTFKTMTTFMPPPPAATFLAFHPQDNNIIAIGMDDSTIQIYNVRVDEVKSKLKGHSKRITGLAFSHVLSVLVSSGADAQLCVWNSDGWEKQKTRFLQVPTGRTTTAQSDTRVQFHQDQIHFLVVHETQLAIFETTKLECVKQWLPRESSAPISHAVFSCDSQLVYASFLDATVCVFSAANLRLRCRINPSSYPPPNVSSNVHPLVIAAHPQEPNQFALGLSDGGVHVFEPLESEGKWGVPPPAENGSASSVAAIPSVGPSGSDQAQR

SEQ ID NO: 15662 - protein, 1143 aa, Euphorbia peplus
MSSLSRELVFLILQFLDEEKFKETVHKLEQESGFFFNMKYFEDEVHGGNWDEVEKYLSGFTKVDDNRYSMKIFFEIRKQKYLEALDKHDRSKAVDILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSIPKAGGFPPLGAHGPFQPTPAPVPAPLAGWMSNPSTVTHPAVSGGGAIGLGAPSMPAALKHPRTPPTNSSVDYPSGDSDHVAKRTRPMGITDEVNLPVNVLPVPFPGHGHSQTFNPPDDLPKTVARTLNQGSSPMSMDFHPIEQTILLVGTNVGDVALWEAGSRERLVLRNFKVWDLSTCSMPLQAALVKDPGVSVNRVIWSPDGSLFGVAYSRHIVQIYSYHRGDDVRQHLEIDAHVGGVNDLAFSTPNKQLCVITCGDDKTIKVWDAATGAKQYTFEGHEAPVYSVCPHYKENIQFIFSTALDGKIKAWLYDNLGSRVDYDAPGRWCTTMAYSADGTRLFSCGTSKDGESHIVEWNESEGNVKRSYQGFRKRSLGVVQFDTTKNRFLAAGDDFSIKFWDMDNVQLLTSIDADGGLPASPRIRFNKDGTLLAVSANENGIKILSNSDGHRLLRTFENLSYDASRATEAVTKPIINPITAAAAAAAAAAAGATSAGLSDRNNSVVTIPGMNGDARNLGDVKPRITEESNDKSKIWKLTEISEPSQCRSLRLPENMRVNKISRLIYTNSGNAILALASNAIHLLWKWQRSERNSNAKATANVPPQLWQPSSGILMTNDVTDTNLEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKTRFLQVPPGRTTSGHSDTRVQFHLDQIQFLVVHETQLAIYEATKLECVKQWVTRDSSAPISHATFSCDSQLVYASFLDATVCVFSAQNLRLRCRINPSSYLPANVSNSNVHPLVIAAHPQEANQFALGLSDGGVHVFEPLESEGKWGVPPPVENGSASSVPATPSVGPSGSDQAQR

SEQ ID NO: 15663 - protein, 1134 aa, Gossypium raimondii
MSSLSRELVFLILQFLDEEKFKETVHRLEQESGFFFNMKYFEDEVHNGNWDEVEKYLSGFTKVDDNRYSMKIFFEIRKQKYLEALDKHDLSKAVEILVKDLKVFATFNEELFKEITQLLTLENFRENEQLSKYGDTKSARAIMLVELKKLIEANPLFRDKLQFPNLRNSRLRTLINQSLNWQHQLCKNPRPNPDIKTLFVDHSCGQPNGARAPSPANNPLLGGLPKAGGFPPLGAHGPFQPTPAPVPAPLAGWMSNPSTVTHPAVSGGAIGLGPSSIPAALKHPRTPPTNPSVDYPSGDSDHVSKRTRPMGISDEVNLPVNVLPVTFPGHGHSQTFNAPDDLPKAVARTLNQGSSPMSMDFHPVQQTLLLVGTNVGDIALWEIGSRERLVLKNFKVWDLSACSMPLQAALVKDPAVSVNRVIWSPDGSLFGVAYSRHIVQIYSYHGGDEVRQHLEIDAHVGGVNDLAFSHPNKQLCVVTCGDDKMIKVWEATNGTKQYTFEGHEAPVYSVCPHYKENIQFIFSTALDGKIKAWLYDNMGSRVDYEAPGRWCTTMAYSADGTRLFSCGTSKEGESFIVEWNESEGAVKRTYQGFRKRSLGVVQFDTTKNRYLAAGDDFSIKFWDMDNVQPLTSVDADGGLPASPRIRFNKDGSLLAVSANDNGIKILANSDGMRLLRTLENLSYDASRTSEAPKPTINPISAAAAAVATSAGLADRSASVVAIAGMNGDARSLGDVKPRITEESSDKSKIWKLTEISEPSQCRSLRLPENLRVTKISRLIFTNSGNAILALASNAIHLLWKWQRSERNSNGKATASVPPQLWQPSSGILMTNDVADTNPEEAVPCFALSKNDSYVMSASGGKISLFNMMTFKTMATFMPPPPPATFLAFHPQDNNIIAIGMDDSTIQIYNVRVDEVKSKLKGHSKRITGLAFSHVLSVLVSSGADSQLCVWNTDGWEKQRSRFLQVPSGRTPTALSDTRVQFHQDQMHFLVVHETQLAIYETTKLERVKQWVPLESSAPITHATFSCDSQLVYSSFLDATVCVFTAANLRLRCRINPSAYLPASVSSNVHPLVIAAHPSEPNEFALGLSDGGVHVFEPLESENKWGVPPPVENGSSSNMAVTPSVGAPGSEQAQR

SEQ ID NO: 15664 - protein, 1112 aa, Trigonella foenum-graecum
MSSLSRELVFLILQFLEEEKFKEAVHKLEQESGFYFNMKYFEDEVHNGNWDEVEKYLSGFTKVDDNRYSMKIFFEIRKQKYLEALDKHDRSKGVEILVKDLKVFSTFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANMPLLGSLPKVGGFPPLGAHGPFQPTPAPVPMPLAGWMSNPTTVAHASVSGGGAIGLGVGGPSMPDHMSKRTRPIGMSDEGNLPVNVLSATFPGHGHGQAFNSPDDLPKTVLRTLNQGSSPMSMDFHPVQQTLLLVGTNVADIGLWELGSRERLVLRNFKVWDLSACSMPFQAALVKDPAVSVNRVTWSPDGALFGVAYSRHIVQIYSYHGGDEVRQHLEIDAHVGGVNDLAFSHPNKQLCVITCGDDKTIKVWDAATGIKQYTFEGHEAPVYSVCPHYKENIQFIFSTALDGKIKAWLYDNLGSRVDYDAPGRWCTTMAYSADGTRLFSCGTSKEGESSIVEWNESEGAVKRTYQGFRKRSLGVVQFDTTKNRYLAAGDDFSIKFWDMDNIQLLTTVDADGGLPASPRIRFNKDGSLLAVSANENGIKILANGEGIRFLRSLENSLYDSSRTSEAMTKPIINSMSVANAASSAALAERASSAAAIAGMNGDARNLGDIKPRISEESNDKSKIWKLTEINEPSHCRSLKLPENARVTKISRLIYTNSGNAILALASNAIHLLWKWQRNDRNSSGKATASLPPQLWQPSSGILMTNDINDNNTEDAVPCFALSKNDSYVMSASGGKISLFNMMTFKTMTTFMPPPPAATFLAFHPQDNNIIAIGMDDSSIQIYNVRVDEVKSKLKGHTKRVTGLAFSHVLNVLVSAGADSQIFVWNTDGWEKQKNRFLQFPPGRTPPAQADTRVQFHQDQFRFLVVHETQLAIYEATKLECLKQWFPRDAAAPISYATFSCDSHLIFASFLDATICVFSASNLRLRCRINPSAYLSANVSSNIQPLVIAAHPHEPNQFAVGLSDGVVHVFEPLESEGKWGVPPPIENGSASNAVTNSVGASSDEVQR

SEQ ID NO: 15665 - protein, 1134 aa, Gossypium raimondii
MSSLSRELVFLILQFLDEEKFKETVHRLEQESGFFFNMKYFEDEVHNGNWDEVEKYLSGFTKVDDNRYSMKIFFEIRKQKYLEALDKHDLSKAVEILVKDLKVFATFNEELFKEITQLLTLENFRENEQLSKYGDTKSARAIMLVELKKLIEANPLFRDKLQFPNLRNSRLRTLINQSLNWQHQLCKNPRPNPDIKTLFVDHSCGQPNGARAPSPANNPLLGGLPKAGGFPPLGAHGPFQPTPAPVPAPLAGWMSNPSTVTHPAVSGGAIGLGPSSIPAALKHPRTPPTNPSVDYPSGDSDHVSKRTRPMGISDEVNLPVNVLPVTFPGHGHSQTFNAPDDLPKAVARTLNQGSSPMSMDFHPVQQTLLLVGTNVGDIALWEIGSRERLVLKNFKVWDLSACSMPLQAALVKDPAVSVNRVIWSPDGSLFGVAYSRHIVQIYSYHGGDEVRQHLEIDAHVGGVNDLAFSHPNKQLCVVTCGDDKMIKVWEATNGTKQYTFEGHEAPVYSVCPHYKENIQFIFSTALDGKIKAWLYDNMGSRVDYEAPGRWCTTMAYSADGTRLFSCGTSKEGESFIVEWNESEGAVKRTYQGFRKRSLGVVQFDTTKNRYLAAGDDFSIKFWDMDNVQPLTSVDADGGLPASPRIRFNKDGSLLAVSANDNGIKILANSDGMRLLRTLENLSYDASRTSEAPKPTINPISAAAAAVATSAGLADRSASVVAIAGMNGDARSLGDVKPRITEESSDKSKIWKLTEISEPSQCRSLRLPENLRVTKISRLIFTNSGNAILALASNAIHLLWKWQRSERNSNGKATASVPPQLWQPSSGILMTNDVADTSPEEAVPCFALSKNDSYVMSASGGKISLFNMMTFKTMATFMPPPPPATFLAFHPQDNNIIAIGMDDSTIQIYNVRVDEVKSKLKGHSKRITGLAFSHVLSVLVSSGADSQLCVWNTDGWEKQRSRFLQVPSGRTPTTLSDTRVQFHQDQMHFLVVHETQLAIYETTKLERVKQWVPLESSAPITHATFSCDSQLVYASFLDATVCVFTAANLRLRCRINPSAYLPASVSSNVHPLVIAAHPSEPNEFALGLSDGGVHVFEPLESENKWGVPPPVENGSSSNMAATPSVGAPGSEQAQR

SEQ ID NO: 15666 - protein, 1138 aa, Fragaria vesca
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVDILVKDLKVFATFNEELFKEITQLLTLDNFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPIPLAGWMSNASTVTHPAVSEGGAIGLGGPSITAALKHPRTPPTNPSVEYPSGDSDHVSKRTRPMGLSNEVNLPVNILPVSFPGHSHSQALNAPDDLPKNVARTLNQGSSPMSMDFHPVQLTLLLVGTNVGDIGLWEVGSRERLVLRNFKVWDLGSCSMPLQAALVKDPGVSVNRVIWSPDGSLFGVAYSRHIVQIYSYHGGDDIRQHLEIDAHVGGVNDLAFSHPNKQLCVITCGDDKTIKVWDAATGSKQYTFEGHEAPVYSVCPHYKENIQFIFSTALDGKIKAWLYDNLGSRVDYDAPGRWCTTMAYSADGTRLFSCGTSKEGESYIVEWNESEGAVKRTYQGFRKRSFGVVQFDTTKNRFLAAGDDFSIKFWDMDNVQLLTTVDADGGLPASPRIRFNKDGTLLAVSANENGIKILGNADGIRLLRTFENLSYDASRTSEVVTKPAMNPISVAAAAAAAASSAGLAERSASAVAISGMNGEARNLGDVKPRITEESNDKSKIWKLTEINEPSQCRSLRLPENMRVTKISRLIYTNSGNAILALASNAIHLLWKWQRNDRTSVSKATASVSPQLWQPTSGILMTNDVTDTSSEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQVCVWNSDGWEKQKSRFLQLPAGRTPSSQSDTRVQFHQDQTHFLVVHETQLAIFETTKLECVKQWVPRDSAAPISHATFSCDSQLIYASFLDATVCVFSAANLRLRCRINPPVYLPANVSSSNVQPLVIAAHPQEPNQFALGLSDGAVHVFEPLESEGKWGVPPPAENGSASSVPASQVGNSSSEQAQR

SEQ ID NO: 15667 - protein, 1133 aa, Gossypium raimondii
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGAIGLGASIPAALKHPRTPPTNPSVDYPSGDSDHVSKRTRPMGISDEVNLPVNVMPVPFQGHGHSQAFSAPDDLPRAVARMLNQGSSPMSMDFHPVQQTLLLVGTNVGDIALWEAGSRERLVSRNFKVWDLTACSMPLQAALVKDPAVSVNRVIWSPDGSLFGVAYSRHIVQIYSYHGGDEVRQHLEIDAHVGGVNDIAFSHPNKLLCVITCGDDKTIKVWDASNGTKQYTFEGHEASVYSVCPHYKENIQFIFSTAIDGKIKAWLYDNMGSRVDYEAPGRWCTTMAYSADGTRLFSCGTSKDGESFIVEWNESEGAVKRTYQGFRKRSLGVVQFDTTKNKYLAAGDDFSIKFWDMDNIQPLTSFDADGGLPASPRIRFNKDGSLLAVSTNDNGIKILANSDGMRLLRTLENLSYDALRTAEAPKPTINPISAAAAAAAAAATSAGLADRSVAIAGMNGDARSLGDVKPRITEEPSDKSKIWKLTEINEPSQCRSLRLPENLRVTKISRLIFTNSGNAILALASNAIHLLWKWQRSDRNSNGKATASVAPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSHVLSVLVSSGADSQLCVWNTDGWEKQKARFLQVPAGRTPTALSDTRVQFHQDQIHFLVVHETQLAIYETTKLDCMKQWVPRDSSAPITHATFSCDSQLVYASFLDASVCVFTAANLRLRCRINPSAYLPTNISSNVHPLVIAAHPSEPNEFALGLSDGGVHVFEPLESENKWGVPPPVENGSASSMTATPSVGAPGSEQAQR

SEQ ID NO: 15668 - protein, 141 aa, Fagus grandifolia
MKYFEDEVHNGNWDEVEKYLSGFTKVDDNRYSMKIFFEIRKQKYLEALDKHDRPKAVDILVKDLKVFATFNEELFKEITQLLTLENFRENEQLSKYGDTKSARAIMLVELKKLIEANPLFRDKLQFPNLKIQGYGPSSTKA

SEQ ID NO: 15669 - protein, 1133 aa, Gossypium raimondii
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGAIGLGASIPAALKHPRTPPTNPSVDYPSGDSDHVSKRTRPMGISDEVNLPVNVMPVPFQGHGHSQAFSAPDDLPRAVARMLNQGSSPMSMDFHPVQQTLLLVGTNVGDIALWEAGSRERLVSRNFKVWDLTACSMPLQAALVKDPAVSVNRVIWSPDGSLFGVAYSRHIVQIYSYHGGDEVRQHLEIDAHVGGVNDIAFSHPNKLLCVITCGDDKTIKVWDASNGTKQYTFEGHEASVYSVCPHYKENIQFIFSTAIDGKIKAWLYDNMGSRVDYEAPGRWCTTMAYSADGTRLFSCGTSKDGESFIVEWNESEGAVKRTYQGFRKRSLGVVQFDTTKNKYLAAGDDFSIKFWDMDNIQPLTSFDADGGLPASPRIRFNKDGSLLAVSTNDNGIKILANSDGMRLLRTLENLSYDALRTAEAPKPTINPISAAAAAAAAAATSAGLADRSVAIAGMNGDARSLGDVKPRITEESSDKSKIWKLTEINEPSQCRSLRLPENLRVTKISRLIFTNSGNAILALASNAIHLLWKWQRSDRNSNGKATASVAPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSHVLSVLVSSGADSQLCVWNTDGWEKQKARFLQVPAGRTPTALSDTRVQFHQDQIHFLVVHETQLAIYETTKLDCMKQWVPRDSSAPITHATFSCDSQLVYASFLDASVCVFTAANLRLRCRINPSAYLPTNISSNVHPLVIAAHPSEPNEFALGLSDGGVHVFEPLESENKWGVPPPVENGSASSMTATPSVGAPGSEQAQR

SEQ ID NO: 15670 - protein, 1135 aa, Vitis vinifera
MSSLSRELVFLILQFLDEEKFKETVHKLEQESGFFFNMKYFEDEVHSGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPHLKNSRLRTLINQSLNWQHQLCKNPRPNPDIKTLFVDHTCGQPNGARAPSPANNPLLGSLPKAGGFPPLGAHGPFQPTPAPVPTPLWMSNPSTVTHPAVSGGPIGLGAPSIPAALKHPRTPPTNPSVDYPSGDSEHVAKRGRPMGISDEVNLPVNVLPVTFPGHGHSQAFNAPDDLPKTLVRNLTQGSSPMSMDFHPVQQTLLLVGTNVGDIGLWEVGSKQKLVSRNFKVWDIGACSVPLQAALAKDPGVSVNRIIWSPDGSLFGVAYSRHIVQIYSYHGGDDVRQHLEIDAHAGGVNDLAFSHPNKQLCVITCGDDKTIKVWDATNGTKQYTFEGHEDAVYSVCPHYKENIQFIFSTALDGKIKAWLYDNLGSRVDYDAPGRWCTTMAYSADGTRLFSCGTSKDGDSYIVEWNESEGAVKRTYQGFRKRSLGVVQFDTTKNRFLAAGDDFSIKFWDMDNIQLLTILDAEGGLPGLPASPRIRFNKDGTLLAVSANENSIKILANSDGLRLLRTFDNLSYDASRASESVTKPAINSISAAAAATSAGLADRGASVVAIAGMNGDARNMGDVKPRLAEETNDKSKIWKLTEINETSQCRSLRLQENLRITKISRLIYTNSGNAILALASNAIHFLWKWQRNDRNSSGKATATVSPQLWQPTSGILMTNDVADTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWSSDGWEKQKSRFLQVPAGRTSTGQSDTRVQFHQDQTHFLVVHETQLAIYEATKLDCVKQWVQREAAAPISHATFSCDSLLVYASFLDATVCVFSAANLRLRCRINPTAYLPASVSNSNVHPLVIAAHPQEPNQFALGLSDGGVCVFEPLESEGKWGVPPPVENGSASSVPATPSVGPSGSDQPQR

SEQ ID NO: 15671 - protein, 1138 aa, Vitis vinifera
MSSLSRELVFLILQFLDEEKFKETVHKLEQESGFFFNMKYFEDEVHSGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPHLKNSRLRTLINQSLNWQHQLCKNPRPNPDIKTLFVDHTCGQPNGARAPSPANNPLLGSLPKAGGFPPLGAHGPFQPTPAPVPTPLWMSNPSTVTHPAVSGGPIGLGAPSIPAALKHPRTPPTNPSVDYPSGDSEHVAKRGRPMGISDEVNLPVNVLPVTFPGHGHSQAFNAPDDLPKTLVRNLTQGSSPMSMDFHPVQQTLLLVGTNVGDIGLWEVGSKQKLVSRNFKVWDIGACSVPLQAALAKDPGVSVNRIIWSPDGSLFGVAYSRHIVQIYSYHGGDDVRQHLEIDAHAGGVNDLAFSHPNKQLCVITCGDDKTIKVWDATNGTKQYTFEGHEDAVYSVCPHYKENIQFIFSTALDGKIKAWLYDNLGSRVDYDAPGRWCTTMAYSADGTRLFSCGTSKDGDSYIVEWNESEGAVKRTYQGFRKRSLGVVQFDTTKNRFLAAGDDFSIKFWDMDNIQLLTILDAEGGLPGLPASPRIRFNKDGTLLAVSANENSIKILANSDGLRLLRTFDNLSYDASRASESVTKPAINSISAAAAAAAATSAGLADRGASVVAIAGMNGDARNMGDVKPRLAEETNDKSKIWKLTEINETSQCRSLRLQENLRITKISRLIYTNSGNAILALASNAIHFLWKWQRNDRNSSGKATATVSPQLWQPTSGILMTNDVADTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWSSDGWEKQKSRFLQVPAGRTSTGQSDTRVQFHQDQTHFLVVHETQLAIYEATKLDCVKQWVQREAAAPISHATFSCDSLLVYASFLDATVCVFSAANLRLRCRINPTAYLPASVSNSNVHPLVIAAHPQEPNQFALGLSDGGVCVFEPLESEGKWGVPPPVENGSASSVPATPSVGPSGSDQPQR

SEQ ID NO: 15672 - protein, 1132 aa, Gossypium raimondii
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPTLKNSRLRTLINQSLNWQHQLCKNPRPNPDIKTLFVDHSCGQPNGARAPSPANNPLLGSLPKAGGFPPLGAHGPFQATPAPVPAPLAGWMSSPSAVTHPAVSAGAIGLGASSIPAALKHPRTPPTNPSVDYPSADSDHVSKRARPMGISDEVNLPVNVLQVTFPGHGHSQTFNAPDDLPKAVARTLNQGSSPMSMDFHPVQQTLLLVGTNVGDIALWEVGSRERLVSKNFKVWDLSVCSMPLQAALVKDPAVSVNRVIWSPDGSLFGVAYSRHIVQIYSYHGGDEVRQHLEIDAHVGGVNDIAFSLPNKQLCVITCGDDKTIKVWDASNGTKQYTFEGHEAPVYSVCPHYKENIQFIFSTALDGKIKAWLYDNMGSRVDYEAPGRWCTTMAYSADGTRLFSCGTSKEGESFIVEWNESEGAVKRTYQGFRKRSLGVVQFDTTKNRYLAAGDDFSIKFWDMDNVQPLTSYDAEGGLPASPRIRFNKDGSLLAVSANDNGIKILANSDGMRLLRTLENLSYDASRTPEAPKPTINPISAAAAATSAALADRSASVVAIPGMNGDARSFADVKPRITEESSDKSKIWKLTEISESSQCRSLRLPENLRVTKISRLIFTNSGNAILALASNAIHLLWKWQRSDRNSNGKATASVSPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLIGHSKRITGLAFSHALNVLVSSGADSQLCVWNTDGWEKQKTKFLQIPVGITPTAQSETRVQFHQDQIRLLVVHETQLALYETTKLECFKQWVPRESFAPITHATFSCDSQLVYASFLDATICVFVAANLRPRCRINPSAYLPASVSSNVHPLVIAAHPSEPNEFAVGLSDGGVHVFEPLESENRWGVPQPADNGSASSITATPSVAAQGSEQAQR

SEQ ID NO: 15673 - protein, 1132 aa, Gossypium raimondii
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPTLKNSRLRTLINQSLNWQHQLCKNPRPNPDIKTLFVDHSCGQPNGARAPSPANNPLLGSLPKAGGFPPLGAHGPFQATPAPVPAPLAGWMSSPSAVTHPAVSAGAIGLGASSIPAALKHPRTPPTNPSVDYPSADSDHVSKRARPMGISDEVNLPVNVLQVTFPGHGHSQTFIAPDDLPKAVARTLNQGSSPMSMDFHPVQQTLLLVGTNVGDIALWEVGSRERLVSKNFKVWDLSVCSMPLQAALVKDPAVSVNRVIWSPDGSLFGVAYSRHIVQIYSYHGGDEVRQHLEIDAHVGGVNDIAFSLPNKQLCVITCGDDKTIKVWDASNGTKQYTFEGHEAPVYSVCPHYKENIQFIFSTALDGKIKAWLYDNMGSRVDYEAPGRWCTTMAYSADGTRLFSCGTSKEGESFIVEWNESEGAVKRTYQGFRKRSLGVVQFDTTKNRYLAAGDDFSIKFWDMDNVQPLTSYDAEGGLPASPRIRFNKDGSLLAVSANDNGIKILANSDGMRLLRTLENLSYDNSRTPEAPKPTINPISAAAAATSAALADRSASVVAIPGMNGDARSFADVKPRITEESSDKSKIWKLTEISESSQCRSLRLPENLRVTKISRLIFTNSGNAILALASNAIHLLWKWQRSDRNSNGKATASVSPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLIGHSKRITGLAFSHALNVLVSSGADSQLCVWNTDGWEKQKTKFLQIPVGITPTAQSETRVQFHQDQIRLLVVHETQLALYETTKLECFKQWVPRESFAPITHATFSCDSQLVYASFLDATICVFVAANLRPRCRINPSAYLPASVSSNVHPLVIAAHPSEPNEFAVGLSDGGVHVFEPLESENRWGVPQPADNGSASSITATPSVAAQGSEQAQR

SEQ ID NO: 15674 - protein, 1144 aa, Populus trichocarpa
MSSLSRELVFLILQFLDEEKFKETVHKLEQESGFFFNMKYFEDEVHNGNWDEVEKYLSGFTKVDDNRYSMKIFFEIRKQKYLEALDKHDRSMAVEILVKDLKVFSTFNEELFKEITQLLTLENFRENEQLSKYGDTKSARAIMLVELKKLIEANPLFRDKLQFPNLKNSRLRTLINQSLNWQHQLCKNPRSNPDIKTLFVDHSCGQPNGARAPSPANNPLLGSLPKAGGFPPLGAHGPFQPAPAPVPAPLAGWMSTPSTVTHSAVSGGGAIGLGAPSIPAALKHPRTPPTNLSVDYPSGDSDHVAKRVRPMGISDEVNLPVNVLPVSFPGHGHGHGHGQAFNAPDDLPKVVARTLNQGSSPMSMDFHPLQLTLLLVGTNVGDIGLWEVGSRERLVLRIFKVWDLNACSMPLQAALAKDPGVSVNRVIWSPDGSLFGVAYSRHIVQIYSYHGNDEVRQHLEIDAHVGGVNDLAFSTPNKQLCVITCGDDKTIKVWDASTGAKLYTFEGHEAPVYSICPHYKENIQFIFSTALDGKIKAWLYDNLGSRVDYEAPGRWCTTMAYSADGTRLFSCGTSKDGDSFIVEWNESEGAVKRTYLGFRKQSWGVVQFDTTKNRFLAAGDDFSIKFWDMDSVQLLTTIDADGGLPASPRIRFNKDGTLLAVSANDNGIKILANTDGIRLLRTFENLSFDASRTSESIAKPTVNPISAAAVAAAAAAATSTGLADRSASVVAIAGMNGDARNLGDVKPRLTEESNDKSKIWKLTEINEPSQCRSLRLPENLRVTKISRLIYTNSGNAILALASNAIHLLWKWQRSDRNASGKATAGVSPQLWQPSSGILMTNDSTDTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNMLVSSGADAQLCVWNSDGWEKQKARFLQVPAGRTPTAQSDTRVQFHQDQIHFLVVHETQLAIYETTKLECVKQWVLRESSAPISHAVFSCDSHLVYASFLDATVCVFSAMNLRLRCRINPCTYLSPNVSSNVHPLVIAAHPQEPNQFALGLSDGGVHVFEPLESEGKWGVPPPAENGSASSVPATPSVGPSGSDQAQR

SEQ ID NO: 15675 - protein, 1136 aa, Chenopodium quinoa
MSSLSRELVFLILQFLDEEKFKETVHKLEQESGFFFNMKYFEDEVHNGNWDEVERYLSGFTKVDDNRYSMKIFFEIRKQKYLEALDKHDRSKAVDILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGPIGLGAPSMPAALKHPRTPPTNSSMDYPSGDSDHVAKRTRPIGISDEVNLPVNVLPVSFPGHGHTQPFNAPDDLPKSVVRTLNQGSSPMSMDFHPVQLTLLLVGTNVGDIALWEVGSRERLVLRNFKVWELSTCSMPLQSALVKDPAVSVNRVIWSPDGSLFGVAYSRHIVQIYSYHGNEDVRQHLEIDAHAGGVNDIAFSTPNKQLCVITCGDDKTIKVWDAATGSKQYTFEGHEAPVYSVCPHYKENIQFIFSTAVDGKIKAWLYDNLGSRVDYDAPGRWCTTMAYSQDGTRLFSCGTSKDGESHIVEWNESEGAVKRTYQGFRKRSLGVVQFDTTKNRYLAAGDDFSIKFWDMDNVQLLTSIDADGGLPASPRIRFNKDGTLLAISASENGIKIVANSDGLRLLRTYENLSYDSSRASESLTKPSINPISAAAAAAATSSGLPDRSAPMISMGGMNVDARSMGDVKSRILEETNDKSKIWKLCEISEPAQCRSLRLPEHMRAAKISRLIYTNSGNAILALASNAIHLLWKWQRNERNASGKASANVPPQLWQPSSGILMTNDISDASPEEAVPCFALSKNDSYVMSASGGKISLFNMMTFKTMTVFMPPPPAATFLAFHPQDNNIIAIGMDDSTIQIYNVRVDEVKSKLKGHSKRITGLAFSHSLNVLVSSGADAQICVWGSDNWEKQRSKFLQLPAGRAPTAPSDTRVQFHQDQIHFLVVHETQLAIFETKQLECVKQWVPRESSAPISHATFSCDSQLVYASFLDATVCVFSAANLRLRCRINPSAYLPANVSSSNVHPLVIAAHPQEANQFAVGLSDGGVHVFEPLESEGKWGVPPPMENGSAGSGPTTPSVGPSGSDQQQR

SEQ ID NO: 15676 - protein, 1139 aa, Chenopodium quinoa
MSSLSRELVFLILQFLDEEKFKETVHKLEQESGFFFNMKYFEDEVHNGNWDEVERYLSGFTKVDDNRYSMKIFFEIRKQKYLEALDKHDRSKAVDILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGPIGLGAPSMPAALKHPRTPPTNSSMDYPSGDSDHVAKRTRPIGISDEVNLPVNVLPVSFPGHGHTQPFNAPDDLPKSVVRTLNQGSSPMSMDFHPVQLTLLLVGTNVGDIALWEVGSRERLVLRNFKVWELSTCSMPLQSALVKDPAVSVNRVIWSPDGSLFGVAYSRHIVQIYSYHGNEDVRQHLEIDAHVGGVNDIAFSTPNKQLCVITCGDDKTIKVWDAATGSKQYTFEGHEAPVYSVCPHYKENIQFIFSTAVDGKIKAWLYDNLGSRVDYDAPGRWCTTMAYSQDGTRLFSCGTSKDGESHIVEWNESEGAVKRTYQGFRKRSLGVVQFDTTKNRYLAAGDDFSIKFWDMDNVQLLTSIDADGGLPASPRIRFNKDGTLLAISASENGIKIVANSDGLRLLRTYENLSYDSSRASESLTKPSINPISAAAAAAAAAATSSGLPDRSAPMISMGGMNGDARSMGDVKSRILEETNDKSKIWKLCEISEPAQCRSLRLPEHMRAAKISRLIYTNSGNAILALASNAIHLLWKWQRNERNASGKASANVPPQLWQPSSGILMTNDISDASPEEAVPCFALSKNDSYVMSASGGKISLFNMMTFKTMTVFMPPPPAATFLAFHPQDNNIIAIGMDDSTIQIYNVRVDEVKSKLKGHSKRITGLAFSHSLNVLVSSGADAQICVWGSDNWEKQRSKFLQLPAGRAPTAPSDTRVQFHQDQIHFLVVHETQLAIFETKQLECVKQWVPRESSAPISHATFSCDSQLVYASFLDATVCVFSAANLRLRCRINPSAYLPANVSSSNVHPLVIAAHPQEANQFAVGLSDGGVHVFEPLESEGKWGVPPPMENGSAGSGPTTPSVGPSGSDQQQR

SEQ ID NO: 15677 - protein, 1132 aa, Sesamum indicum
MSSLSRELVFLILQFLDEEKFKETVHKLEQESGFFFNMKYFEDEVHNGNWEEVERYLSGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGGAVPKPGGFPPLGAHVPFQPTPAPVPTPLAGWMSNPPTGTHPAVSGGPIGLGAPTIPAALKHPRTPPTNPSVDFPSADSEHASKRTRPLGISDEVNLPVNVLPVSFPGHAHSQTFSAPDDLPKTVARTLNQGSSPMSMDFHPIQQTLLLVGTNVGDLGLWEVGSRERLVQRNFKVWDLGSCTMPLQAALVKDPGVSVNRVIWSPDGSLFGVAYSRHLVQIFSYHGNDDVRQHLEIDAHIGGVNDLAFSHPNKQLSVITCGDDKFIKVWDATTGTKQYTFEGHEAPVYSVCPHHKENIQFIFSTALDGKIKAWLYDNLGSRVDYDAPGRWCTTMAYSADGTRLFSCGTSKDGESHIVEWNESEGAVKRTYQGFRKRSLGVVQFDTTKNRFLAAGDDFSVKFWDMDNTQLLTSTDADGGLPASPRIRFNKDGTLLAVSANENGIKILANTDGLRLLRTFENLAFDASRASEAAKPTVNPISAAAASSAGLTERVASVVSISAMNGDARNLGDVKPRITEETNDKSKIWKLSEISEPSQCRSLKLPENLRVTKISRLIYTNSGNAILALASNAIHLLWKWQRSERNSSGKATATVPPQLWQPSSGILMTNDVSDTNPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWSSDGWEKQKSRFLQLPSGRSPAAQSETRVQFHQDQIHFLVVHETQLAIYETTKLECVKQWVPRESAAPISHATFSCDSQLVYASFLDATVCIFTAAHLRLRCRINPSAYLSPGVSSNVHPLVIAAHPQEPNQFALGLSDGSVHVFEPLESEGKWGVPPPAENGSTSSVPTTPLVGASASDQAQR

SEQ ID NO: 15678 - protein, 582 aa, Cajanus cajan
MAYSADGTRLFSCGTSKEGESSIVEWNESEGAVKRTYQGFRKRSLGVVQFDTTKNRYLAAGDDFSIKFWDMDNIQLLTTVDADGGLPASPRIRFNKDGALLAVSANENGIKILANTDGIRLLRTLENSIYDTSRTSEAMTKPTINPIAAAAAAAATATSVALAERASSMVAITGMNGDARNMGDVKPRISEESNDKSKIWKLTEINEPSQCRSLKLPENVRVNKISRLIYTNSGNAILALASNAIHLLWKWQRSDRNSSGKATASVLPQLWQPSSGILMTNDITDSNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQLCVWNTDGWEKQKSRFLQLPAGRTPPAQADTRVQFHQDQIRFLVVHETQLAIYEATKLECLKQWFPRDSAAPISHATFSCDSQLVYASFLDATVCVFSASNLRLRCRINPSAYLSASVSSNVQPLVITAHPQEPNQFAVGLSDGGVHVFEPLESEGKWGVPPPIENGSTSNIAATSVGASSDEAQR

SEQ ID NO: 15679 - protein, 913 aa, Panax ginseng
MCTTKWCTCSITCNNPLLGSLPKAGVFPPLGAHGPFQPTGAPVPTPLAGWMSNPSTVTHPPVSGGAIGLGGPSMPAALKHPRTPPANPSLDYPSGDSDHVTKRTRPMGISDEVNLPINVLPVSFPGHTHSQAFNAPDDLPKSVARTLNQGSSPMSMDFHPIQQTLLLVGTNVGDIGLWEIGSRERLVLRNFKVWDLGACSMPLQAALVKDPGVSVNRVIWSPDGSLFGVAYSRHIVQIYSYHRGDDLRQHLEFDAHIGGVNDLAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKDGESHIVEWNESEGAVKRTYLGFRKRSLGVVQFDTTKNRFLAAGDEFSIKFWDMDNVQLLTSIDGDGGLPASPRIRFNKDGSLLAVSTNENGIKILANSDGLRLLRTFENQSYDASRAPETVKVADLENLILAPLHNGDSRNLGDIKPRITEESNDKSKIWKLAEVNETSQCRSMKLPENMRVTKISRLIYTNSGNAILALASNAIHLLWKWQRSDRNSSGKATASVSPQLWQPSSGILMTNDVTDTNPEDAVPCFALSKNDSYVMSASGGKISLFNMMTFKTMTTFMPPPPAATFLAFHPQDNNIIAIGMDDSSIQIYNVRVDEVKSKLKGHSKRITGLAFSHVLNVLVSSGADAQLCVWSSDGWEKQKTRYLQVPAGRTSTAQSDTRVQFHQDQIHFLVVHETQLAIYDATKLECVKQWVPRESAAPISHATFSCDSQLVYASFLDASLCVFTAAHLRLRCRISPMAYLSPSVSNSNIHPLVIAAHPQEPNQFALGLSDGGVHVLEPLESEGKWGLPPPVENGSASSVPATPSVGASGSDQAQR

SEQ ID NO: 15680 - protein, 1143 aa, Valeriana officinalis
MSSLSRELVFLILQFLDEEKFKETVHKLEQESGFFFNMKYFEEEVHNGNWDEVERYLSGFTKVDDNRYSMKIFFEIRKQKYLEALDKHDRSKAVEILVKDLKVFSSFNEELFKEITQLLTLENFRENEQLSKYGDTKSARAIMLVELKKLIEANPLFRDKLQFPSLKNSRLRTLINQSLNWQHQLCKNPRPNPDIKTLFVDHLCGQPNGARAPSPANNPLLGSLPKAGVFPPLGAHGPFQPTQAPVPTPLAGWMSNPPAVTHPAVSGGPIGLGGPSITAALKHPRTPSTNPSLDYPSGDSDHVTKRTRAMGITDEVNLPVNVMPVSFPGGHGGHTQAFVAPDDLPKTVARTLNQGSSAMSMDFHPVQQTLLLVGTNVGDIGLWEVGSRERLVLKNFKVWDLSACSMPLQAALVKDPGVSVNRVIWSPDGSLFGVAYSRHIVQVYSYHGSDDVRQHLEIDAHIGGVNDLAFSHPNKQLCVITCGDDKTIKVWDANTGTRQYTFEGHEAPVYSVCPHYKENIQFIFSTALDGKIKAWLYDNLGSRVDYDAPGRWCTTMAYSADGIRLFSCGTSKDGESHIVEWNESEGAVKRTYQGFRKRSLGVVQFDTTKNRFLAAGDDFSIKFWDMDNVQLLTSIDADGGLPASPRIRFNKDGALLAVSANENGIKILANSDGLRLLRTYENLSYDSSRAPPESSKPGLHHPMSAAAAAAATSAGLADKAAAAASAAAANGDARNMGDVKPRLVEESNDKSKIWKLTEIAEPSQCRSLKLPENTRMNKVSRLIYTNSGNAILALASNAIHLLWKWQRGERNSTGKATANVLPQLWQPSSGIIMTNDTTETNPEEAVACFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWSSNEWEKLKARYLQVPAGRTPTSSVSDTRVQFHQDQIHFLVVHETQLAIYETTKLECVKQWVPRENAAPIAHATFSCDSQLVYASFLDATLCVFTASHLRLRCRINPLAYLSPNVSNSNVQPVVIAAHPQEANQFAIGLSDGGVHIFEPLESEGKWGVPPPAENGSGSSMPNTPNAAAGGTSGSDQPQR

SEQ ID NO: 15681 - protein, 1138 aa, Mimulus guttatus
MSSLSRELVFLILQFLDEEKFKETVHKLEQESGFFFNMKYFEDEVHNGNWEEVEKYLSGFTKVDDNRYSMKIFFEIRKQKYLEALDKHDRSKAVDILVKDLKVFASFNEDLFKEITQLLTLENFRENEQLSKYGDTKSARAIMLVELKKLIEANPLFRDKLQFPNLKNSRLRTLINQSLNWQHQLCKNPRPNPDIKTLFVDHSCGQQNGARAPSPANNPLLGGPVQKPGGFPPLGAHPFQPAPAPVPAPLAGWMSNPPTATHAAVSGAPLGLGGPAMPGREFNISALKHPRTPPTNASVDFPSGDSEHASKRTRPLGLTDEVNLPVNVMPVSFPAHAHSQSFNAPDDLPKTVGRVLNQGSSPMSMDFHPIQQTLLLVGTNVGDIGLWEVGSRERLVQRNFKVWDLSACTMPLQAGLVKDPGVSVNRVIWSPDGSLFGVAYSRHLIQIYSYHGNDDVRQHLEIDAHVGGVNDLAFSHPNKQLSVITCGDDKLIKVWDATTGTKQYTFEGHEAPVYSVCPHHKENIQFIFSTALDGKIKAWLYDNLGSRVDYDAPGRWCTTMAYSADGTRLFSCGTSKDGESHIVEWNESEGAVKRTYQGFRKRSLGVVQFDTTKNRFLAAGDDFSIKFWDMDNTQLLTSSEADGGLPASPRIRFNKDGSLLAISANENGIKVLANNDGLRLLRTFENIAFDASRTSEAAKPTVNPISASVASSAGLTDRVPSSVGISAMNGDTRNLGDVKPRIIEETNDKSKIWKLSEINEPSQCRSLKLPENLRVTKISRLIYTNSGNAILALASNAVHLLWKWQRSDRNSNGKATATVSPQLWQPSSGILMTNDVADTSPEEAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKSRFLQLPSGRSPGAQSETRVQFHQDQLHFLVVHETQLAIYETTKLECVKQWAPRESTAPISHATFSCDSQLVYASFLDSTVCVFTAAQLRLRCRINPSAYLSPNISSNVHPLVIAAHPQEPNQFALGLSDGSVHVFEPLESEGKWGLTPPVENGSSSNAPSSAPAGGGSGSDQPQR

SEQ ID NO: 15682 - protein, 1082 aa, Cicer arietinum
MSSLSRELVFLILQFLDEEKFKETVHKLEQESGFFFNMKYFEDEVHNGNWDEVEKYLSGFTKVDDNRYSMKIFFEIRKQKYLEALDKHDRSKGVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANIPLLGSLPKAGGFPPLGAHGPFQPTPAPVPMPLAGWMSNPTTVAHASVSGGGAIGLGVGIGAPSIPAALKHPRTPPTNPSVDYPSGDSDHVSKRTRPIGMSDEANLPVNVLSATFPGHGHGQAFNSPEDLPKTVLRTLNQGSSPVSMDFHPVQQTLLLVGTNVADIGLWELGSRERLVLRNFKVWDLSACSMPFQAALVKDPAVSVNRVTWSPDGALFGVAYSRHIVQIYSYHGADEVRQHLEIDAHVGGVNDLAFSHPNKQLCVITCGDDKTIKVWDAATGIKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSLGVVQFDTTKNRSLGVVQFDTTKNRYLAAGDDFSIKFWDMDNIQLLTTVDADGGLPASPRIRFNKDGSLLAVSANENGIKILANGDGIRLLRSLENSLYEASRTSEAMTKPTINPMSVATSATSAALAERASSVAAIAGMNGDARNLGDIKPRISEESNDKSKIWKLTEINEPSQCRSLKLPENVRVTKISRLIYTNSGNAILALGSNAIHLLWKWQRNDRNSSGKATASVPPQLWQPSSGILMTNDINDSNTEDAVPCFALSKNDSYVMSASGGKISLFNMMTFKTMTTFMPPPPAATFLAFHPQDNNIIAIGMDDSSIQIYNVRIDEVRSKLKGHTKRITGLAFSHVLNVLVSSGADAQICVWNTDGWEKQKTRFLQFPPGRTPPAQADTRVQFHQDQFRFLVVHETQLAIYEATKLECLKQWFPRDSAAPISHATFSCDSQLVFASFLDATVCVFSASNLRLRCRINPSAYLSANVR

SEQ ID NO: 15683 - protein, 316 aa, Plantago ovata
MSSLSRELVFLILQFLDEEKFKETVHKLEQESGFFFNMKYFEDEVHNGNWEEVGRYLSGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGGAVPKPGGFPPLGAHVPFQQTPSPVPAPLAGWMSNPPTGAHPGASSGPISLGAPSISAALKHPRTPPTNPSVDFPSGDSDHVSKEPGNWEFLMR

SEQ ID NO: 15684 - protein, 1109 aa, Flaveria ramosissima
HKLEQESGFFFNMKYFEDEVHNGNWDEVEKYLSGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKTPRPNPDIKTLFVDHSCGQPNNARAPSPANNPLLGSLPKAGGFPPLGAHGPFQPTQAQVPTPLAGWMSNPPAVAHPAVSGSAIGLGGPSIPAALKHPRTPPTNPSLDFPSGDSDHVSKRTRAMGLTDEVNLPVNVLPVSFPGHSGHSQAFNPSDDLPKTVARNLNQGSSPMSMDFHPIQQTLLLVGTNVGDIGLWEVGSRDKLVLKNFKVWDLSSCSMSLQAALVKDPGVSVKRVIWSPDGSLFGVAYSRHIVQIYSYHGSDDVRQHIEIDAHVGGVNDLAFSSPNKQLCVITCGDDKTIKVWDAATGAKQYTFEGHDAPVYSVCPHYKENIQFIFSTALDGKIKAWLYDNMGSRVDYEAPGRWCTTMAYSADGTRLFSCGTSKEGESHIVEWNESEGAVKRTYIGFRKRSLGVVQFDTTKNRFLAAGDDFAIKYWDMDNVQLLTSVDADGGLPASPRIRFNKDGTLLAVSANENGIKILANSDGLRLLRTFENLSYDAAGRAEPSKPALNTITAAVAASGAALADRVASVGSISGMNGDSRSMVDVKPRITEETNDKSKVWKLTEISESSQCRSLKLPENMRVTKISRLIYTNSGNAILALASNAIHLLWKWQRSERNSNGKATASVAPQLWQPSSGILMTNDVAETNPEESVSCFALSKNDSYVMSASGGKISLFNMMTFKTMTTFMPPPPAATFLAFHPQDNNIIAIGMDDSTIQIYNVRIDEVKSKLKGHSKRITGLAFSHVLNVLVSSGADAQLCVWSSDGWEKQKARYLQLPPGRPPTAQSDTRVQFHHDQIHFLVVHDTQLAIYETTKLECVKQWLVRESFAPISHAMFSCDSQLVYASFLDATVCVFTASNLRLRCRINPSAYLGPSVPSNPNVHPLVIAAHPQEPNQFALGLSDGAVHVFEPLESEGKWGVPPPAENGSTSNVAAAPAGGPSAEQAQR

SEQ ID NO: 15685 - protein, 1102 aa, Gossypium hirsutum
FNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAQVPAPLAGWMSNPSTVTHPAVSGGAIGLGASIPAALKHPRTPPTNPSVDYPSGDSDHVSKRTRPMGISDEVNLPVNVMPVPFQGHGHSQAFSAPDDLPRAVARMLNQGSSPMSMDFHPVQQTLLLVGTNVGDIALWEAGSRERLVSKNFKVWDLTACSMPLQAALVKDPAVSVNRVIWSPDGSLFGVAYSRHIVQIYSYHGGDEVRQHLEIDAHVGGVNDIAFSHPNKLLCVITCGDDKTIKVWDASNGTKQYTFEGHEAPVYSVCPHYKENIQFIFSTAVDGKIKAWLYDNMGSRVDYEAPGRWCTTMAYSADGTRLFSCGTSKDGESFIVEWNESEGAVKRTYQGFRKRSLGVVQFDTTKNKYLAAGDDFSIKFWDMDNIQPLTSFDADGGLPASPRIRFNKDGSLLAVSTNDNGIKILANSDGMRLLRTLENLSYDALRTAEAPKPTINPISAAAAAAAAAAATAATSAGLADRSVAIAGMNGDARSLGDVKPRITEESSDKSKIWKLTEINEPSQCRSLRLPENLRVTKISRLIFTNSGNAILALASNAIHLLWKWQRSDRNSNGKATASVAPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSHVLSVLVSSGADSQLCVWNTDGWEKQKARFLQVPAGRTPTALSDTRVQFHQDQIHFLVVHETQLAIYETTKLDCMKQWIPLDSSAPITHATFSCDSQLVYASFLDASVCVFTAANLRLRCRINPSAYLPTNISSNVHPLVIAAHPSEPNEFALGLSDGGVHVFEPLESENKWGVPPPVENGSTSSMTATPSVGAPGSEQAQR

SEQ ID NO: 15686 - protein, 1095 aa, Gossypium hirsutum
MKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPTLKNSRLRTLINQSLNWQHQLCKNPRPNPDIKTLFVDHSCGQPNGARAPSPANNPLLGSLPKAGGFPPLGAHGPFQPTPAPVPAPLAGWMSNPSAVTHPAVSAGAIGLGASSIPAALKHPRTPPTNPSVDYPSADSDHVSKRARPMGISDEVNLPVNVLQVTFPGHGHSQTFIAPDDLPKAVARTLNQGSSPMSMDFHPVRQTLLLVGTNVGDIALWEVGSRERLVSKNFKVWDLSVCSMPLQAALVKDPAVSVNRVIWSPDGSLFGVAYSRHIVQIYSYHGGDEVRQHLEIDAHVGGVNDIAFSLPNKQLCVITCGDDKTIKVWDASNGTKQYTFEGHEAPVYSVCPHYKENIQFIFSTALDGKIKAWLYDNMGSRVDYEAPGRWCTTMAYSADGTRLFSCGTSKEGESFIVEWNESEGAVKRTYQGFRKRSLGVVQFDTTKNRYLAAGDDFSIKFWDMDNVQPLTSYDAEGGLPASPRIRFNKDGSLLAVSANDNGIKILANSDGMRLLRTLENLSYDNSRTPEAPKPTINPISAAAAATSAALADRSASVVAIPGMNGDARSFADVKPRITEESSDKSKIWKLTEISESSQCRSLRLPENLRVTKISRLIFTNSGNAILALASNAIHLLWKWQRSDRNSNGKATASVSPQLWQPSSGILMTNDVADTNPEEAVPCFALSKNDSYVMSASGGKISLFNMMTFKTMATFMPPPPAATFLAFHPQDNNIIAIGMDDSTIQIYNVRVDEVKSKLIGHSKRITGLAFSHALNVLVSSGADSQLCVWNTDGWEKLKTKFLQIPVGITPTAQSETRVQFHQDQIRLLVVHETQLALYETTKLECFKQWVPRESFAPITHATFSCDSQLVYASFLDATICVFVAANLRPRCRINPSAYLPASVSSNVHPLVIAAHPSEPNEFAVGLSDGGVHVFEPLESENRWGVPQPADNGSASSITATPSVAAQGSEQAQR

SEQ ID NO: 15687 - protein, 1131 aa, Arabidopsis thaliana
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCGPPNGARAPSPVNNPLLGGIPKAGGFPPLGAHGPFQPTASPVPTPLAGWMSSPSSVPHPAVSAGAIALGGPSIPAALKHPRTPPTNASLDYPSADSEHVSKRTRPMGISDEVNLGVNMLPMSFSGQAHGHSPAFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESFIVEWNESEGAVKRTYQGFHKRSLGVVQFDTTKNRYLAAGDDFSIKFWDMDAVQLLTAIDGDGGLQASPRIRFNKEGSLLAVSGNENVIKIMANSDGLRLLHTFENISSESSKPAINSIAAAAAAAATSAGHADRSANVVSIQGMNGDSRNMVDVKPVITEESNDKSKIWKLTEVSEPSQCRSLRLPENLRVAKISRLIFTNSGNAILALASNAIHLLWKWQRNERNATGKATASLPPQQWQPASGILMTNDVAETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNSAPSDTRVQFHQDQAHFLVVHETQLAIYETTKLECMKQWAVRESLAPITHATFSCDSQLVYASFMDATVCVFSSANLRLRCRVNPSAYLPASLSNSNVHPLVIAAHPQEPNMFAVGLSDGGVHIFEPLESEGKWGVAPPAENGSASGAPTAPSVGASASDQPQR

SEQ ID NO: 15688 - protein, 1115 aa, Eutrema halophilum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSPVPTPLAGWMSSPSSVPHPAVSGGAIALGAPSIQALKHPRTPPSNSAVDYPSGDSEHVSKRTRPMGISDEVNLGVNMLPMTFPGQGHGHTQTFKAPDDLPKTVARTLSQGSSPMSMDFHPIKQALLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNIQLLTAIDADGGLQASPRIRFNKEGSLLAVSANDNMIKVMANTDGLRLLHTVENLSSESSKPAINNIAVAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTGALSDTRVQFHQDQVHFLVVHETQLAIYETTKLECMKQWPVRESSAPITHATFSCDSQLIYASFMDATICVFSSANLRLRCRINPSAYLPASLSNSNVHPLVIAAHPQESNMLAVGLSDGGVHIFEPLESEGKWGVAPPPENGSASAVASTPSASDQPQR

SEQ ID NO: 15689 - protein, 1116 aa, Eutrema halophilum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSPVPTPLAGWMSSPSSVPHPAVSGGAIALGAPSIQAALKHPRTPPSNSAVDYPSGDSEHVSKRTRPMGISDEVNLGVNMLPMTFPGQGHGHTQTFKAPDDLPKTVARTLSQGSSPMSMDFHPIKQALLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNIQLLTAIDADGGLQASPRIRFNKEGSLLAVSANDNMIKVMANTDGLRLLHTVENLSSESSKPAINNIAVAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTGALSDTRVQFHQDQVHFLVVHETQLAIYETTKLECMKQWPVRESSAPITHATFSCDSQLIYASFMDATICVFSSANLRLRCRINPSAYLPASLSNSNVHPLVIAAHPQESNMLAVGLSDGGVHIFEPLESEGKWGVAPPPENGSASAVASTPSASDQPQR

SEQ ID NO: 15690 - protein, 1120 aa, Arabidopsis lyrata
MSSLSRELVFLILQFLDEEKFKETVHKLEQESGFFFNMKYFEDEVHNGNWDEVERYLSGFTKVDDNRYSMKIFFEIRKQKYLEALDRHDRPKAVEILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSPVPTPLAGWMSSPSSVPHPAVSGGAIALGAPSIQAALKHPRTPPTNSAVDYPSGDSDHVSKRTRPMGISDEVSLGVNMLPMTFPGQAHGHNQTFKVPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGESFIVEWNESEGAVKRTYQGFHKRSLGVVQFDTTKNRYLAAGDDFSIKFWDMDTIQLLTAIDADGGLQASPRIRFNKEGSLLAVSANDNMIKVMANSDGLRLLHTVENLSSESSKPAINSIPVAERPASVVSIPGMNGDSRNMVDVKPVITEESNDKSKVWKLTELGEPSQCRSLRLPENMRATKISRLIFTNSGNAILALASNAIHLLWKWQRNDRNATGKATASVPPQQWQPASGILMTNDVVETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTSALSDTRVQFHQDQVHFLVVHETQLAIYETTKLECMKQWPVRESSAPITHATFSCDSQLIYTSFMDATICVFSSANLRLRCRVNPSAYLPASLSNSNVHPLVIAAHPQESNMFAVGLSDGGVHIFEPLESEGKWGVAPPPENGSASAVTATASVGASASDQAQR

SEQ ID NO: 15691 - protein, 1119 aa, Eutrema parvulum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSPVPTPLAGWMSSPSSVPHPAVSGGAIALGAPSIQALKHPRTPPSNSAVDYALGDSDHVSKRTRPMGISDEVNLGVNMLPMTFPGQAHGHTQTFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNIQLLTAIDADGGLQASPRIRFNKEGSLLAVSANDNMIKVMANTDGLRLLHTVENLSSESSKPAINNIAVAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTGALSDTRVQFHQDQVHFLVVHETQLAIYETTKLECMKQWPVRESSAPITHATFSCDSQLIYTSFMDATICVFTSANLRLRCRVNPSAYLPASLSNSNVHPLVIAAHPQESNMFAVGLSDGGVHIFEPLESEGKWGVAPPPENGSASGVASTPSVGASASDQPQR

SEQ ID NO: 15692 - protein, 1132 aa, Eutrema halophilum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCGPPNGARASSPVNNPLLGGLPKAGGFPPLGAHGPFQPTASPVPTPLAGWMSSPSSVPHPAVSAGAIALGGPSIPAALKHPRTPPTNAGLDYPSADSEHVSKRTRPMGISDEVNLGVNMLPMSFPGQAAHGHSPAFKAPDDLPKTVARTLTQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDTVQLLTAIDGDGGLQASPRIRFNKEGSLLAVSGNENVIKVMANSDGLRLLHTFENISSETSKPAINSIAAAAAAAATSAGLADRSANVVSMQGMNGDSRNMVDVKPVITEESNDKSKIWKLTEVSEPSQCRSLRLPENLRVAKISRLIFTNSGNAILALASNAIHLLWKWQRNDRNTTGKATASLPPQQWQPASGILMTNDAAETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNAAPSDTRVQFHQDQAHFLVVHETQLAIYETTKLECMKQWPVRESSAPITHATFSCDSQLVYASFMDATICVFSSANLRLRCRVNPSAYLPASLSNSNVHPLVIAAHPQEPNMFAVGLSDGGVHIFEPVESEGKWGVAPPAENGSASGAVAAPSVGASASDQPQR

SEQ ID NO: 15693 - protein, 1123 aa, Eutrema parvulum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSPVPTPLAGWMSSPSSVPHPAVSGGAIALGAPSIQALKHPRTPPSNSAVDYALGDSDHVSKRTRPMGISDEVNLGVNMLPMTFPGQAHGHTQTFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNIQLLTAIDADGGLQASPRIRFNKEGSLLAVSANDNMIKVMANTDGLRLLHTVENLSTESSKPAVNNIAVAERPAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTETNSEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRLTGALSDTRVQFHQDQVHFLVVHETQLAIYETTKLECMKQWPVRESSAPITYATFSCDSQLIYTSFMDATICVFTSANLRLRCRVNPSAYLPASLSNSNVHPLVIAAHPQESNMFAVGLSDGGVHIFEPLESEGKWGVAPPPENGSASGVASTPSVGASASDQPQR

SEQ ID NO: 15694 - protein, 1132 aa, Arabidopsis lyrata
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARAIMLVELKKLIEANPLFRDKLQFPTLRNSRLRTLINQSLNWQHQLCKNPRPNPDIKTLFVDHSCGPPNGARAPSPVNNPLLGGIPKAGGFPPLGAHGPFQPTASPVPTPLAGWMSSPSSVPHPAVSAGAIALGGPSIPAALKHPRTPPTNAALDYPSADSEHVSKRTRPMGISDEVNLGVNMLPMSFSGQAHGHTPAFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESFIVEWNESEGAVKRTYQGFHKRSLGVVQFDTTKNRYLAAGDDFSIKFWDMDTVQLLTAIDGDGGLQASPRIRFNKEGSLLAVSGNENVIKIMANSDGLRLLHTFENISSESSKPAINSIAAAAAAAATSAGHADRSANVVSIQGMNGDSRNMVDVKPVITEESNDKSKIWKLTEVSEPSQCRSLRLPENLRVAKISRLIFTNSGNAILALASNAIHLLWKWQRNERNATGKATASLPPQQWQPASGILMTNDVAETNTTEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNSAPSDTRVQFHQDQAHFLVVHETQLAIYETTKLECMKQWAVRESLAPITHATFSCDSQLVYASFMDATVCVFSSANLRLRCRVNPSAYLPASLSNSNVHPLVIAAHPQEPNMFAVGLSDGGVHIFEPLESESKWGVAPPAENGSASGAATAPSVGASASDQPQR

SEQ ID NO: 15695 - protein, 1128 aa, Brassica napus
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVSNPLLGGLPKAGGFPPLGAHGPFQPTASPVPTPLAGWMSSPSSVPHPAVSAGPIALGGPSIPAALKHPRTPPTNPALDYPSAESEHVSKRTRPMGISEEVSLGVNMLPMSFPGQAHGHSPAFKAPDDLPKTVARTLTQGSSPMSMDFHPIKQTLLLVGTNVGDIGLWEVGSRERLVQKTFKVWDISKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDNVQLLTAIDGDGGLQASPRIRFNKEGSLLAVSGNENVIKVMANSDGLRLLHTFENVSSESSKPAINSLAAAAAATSAAADRSANVVSIQAMNGDARSMVDVKPVITEESNDKSKIWKLTEVSEPSQCRSLRLPENLRVAKISRLIFTNSGNAILALASNAIHLLWKWQRNERNATGKATASLPPQQWQPASGILMTNDAAENNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNTAPSDTRVQFHQDQAHFLVVHETQLAIYETTKLECMKQWPVRESSAPITHATFSCDSQLVYASFMDATICVFSSANLRLRCRVNPSTYLPASLSNSNVHPLVIAAHPQEPNMFAVGLSDGGVHIFEPVESEGKWGVAPPAENGSANGAVATPSVGASASDQPQR

SEQ ID NO: 15696 - protein, 1132 aa, Eutrema parvulum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVNNPLLGGLPKAGGFPPLGAHGPFQPTASPVPTPLAGWMSSPSSVPHPAVSAGAIALGGPSIPAALKHPRTPPTNAALDYPSAESEHVSKRTRPMGISDEVNLGVNMLPMSFPGQAHGHGPAFKAPDDLPKTVARTLTQGSSPMSMDFHPIKQTLLLVGTNVGDIGLWEVGSRERLVQKTFKVWDISKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDTVQLLTAIDGDGGLQASPRIRFNKEGSLLAVSGNENVIKVMANSDGLRLLHTFENISSESSKPAINSLAAAAAAAAATSAGLTDRSANVVSIQGMNGDSRNMVDVKPVITEESNDKSKIWKLTEVSEPSQCRSLRLPENLRVAKISRLIFTNSGNAILALASNAIHLLWKWQRNDRNTTGKATASLPPQQWQPASGILMTNDAAENNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRNKVLPLPQGRPNTAPSDTRVQFHQDQAHFLVVHETQLAIYETTKLECMKQWPVRESSAPITHATFSCDSQLVYASFMDATICVFSSANLRLRCRVNPSAYLPASLSNSNVHPLVIAAHPQEPNMFAVGLSDGGVHIFEPVESEGKWGVAPPAENGSASGAVAAPSVGASASDQPQR

SEQ ID NO: 15697 - protein, 1120 aa, Arabidopsis thaliana
MSSLSRELVFLILQFLDEEKFKETVHKLEQESGFFFNMKYFEDEVHNGNWDEVEKYLSGFTKVDDNRYSMKIFFEIRKQKYLEALDRHDRPKAVDILVKDLKVFSTFNEELFKEITQLLTLENFRENEQLSKYGDTKSARAIMLVELKKLIEANPLFRDKLQFPTLRTSRLRTLINQSLNWQHQLCKNPRPNPDIKTLFVDHSCRLPNDARAPSPVNNPLLGSLPKAEGFPPLGAHGPFQPTPSPVPTPLAGWMSSPSSVPHPAVSGGPIALGAPSIQAALKHPRTPPSNSAVDYPSGDSDHVSKRTRPMGISDEVSLGVNMLPMTFPGQAHGHNQTFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRYTFEGHEAPVYSICPHYKENIQFIFSTALDGKIKAWLYDNMGSRVDYEAPGRWCTTMAYSADGTRLFSCGTSKDGESFIVEWNESEGAVKRTYQGFHKRSLGVVQFDTTKNRYLAAGDDFSIKFWDMDTIQLLTAIDADGGLQASPRIRFNKEGSLLAVSANDNMIKVMANSDGLRLLHTVENLSSESSKPAINSIPMVERPASVVSIPGMNGDSRNMVDVKPVITEESNDKSKVWKLTEVGEPSQCRSLRLPENMRVTKISRLIFTNSGNAILALASNAIHLLWKWQRNDRNATGKATASLPPQQWQPASGILMTNDVAETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTSSLSDTRVQFHQDQVHFLVVHETQLAIYETTKLECMKQWPVRESAAPITHATFSCDSQLIYTSFMDATICVFSSANLRLRCRVNPSAYLPASLSNSNVHPLVIAAHPQESNMFAVGLSDGGVHIFEPLESEGKWGVAPPPENGSASAVTATPSVGASASDQPQR

SEQ ID NO: 15698 - protein, 1119 aa, Arabidopsis thaliana
MSSLSRELVFLILQFLDEEKFKETVHKLEQESGFFFNMKYFEDEVHNGNWDEVEKYLSGFTKVDDNRYSMKIFFEIRKQKYLEALDRHDRPKAVDILVKDLKVFSTFNEELFKEITQLLTLENFRENEQLSKYGDTKSARAIMLVELKKLIEANPLFRDKLQFPTLRTSRLRTLINQSLNWQHQLCKNPRPNPDIKTLFVDHSCRLPNDARAPSPVNNPLLGSLPKAEGFPPLGAHGPFQPTPSPVPTPLAGWMSSPSSVPHPAVSGGPIALGAPSIQALKHPRTPPSNSAVDYPSGDSDHVSKRTRPMGISDEVSLGVNMLPMTFPGQAHGHNQTFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCVTTCGDDKTIKVWDAATGVKRYTFEGHEAPVYSICPHYKENIQFIFSTALDGKIKAWLYDNMGSRVDYEAPGRWCTTMAYSADGTRLFSCGTSKDGESFIVEWNESEGAVKRTYQGFHKRSLGVVQFDTTKNRYLAAGDDFSIKFWDMDTIQLLTAIDADGGLQASPRIRFNKEGSLLAVSANDNMIKVMANSDGLRLLHTVENLSSESSKPAINSIPMVERPASVVSIPGMNGDSRNMVDVKPVITEESNDKSKVWKLTEVGEPSQCRSLRLPENMRVTKISRLIFTNSGNAILALASNAIHLLWKWQRNDRNATGKATASLPPQQWQPASGILMTNDVAETNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQKSKVLQIPQGRSTSSLSDTRVQFHQDQVHFLVVHETQLAIYETTKLECMKQWPVRESAAPITHATFSCDSQLIYTSFMDATICVFSSANLRLRCRVNPSAYLPASLSNSNVHPLVIAAHPQESNMFAVGLSDGGVHIFEPLESEGKWGVAPPPENGSASAVTATPSVGASASDQPQR

SEQ ID NO: 15699 - protein, 1130 aa, Brassica rapa
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVSNPLLGGLPKAGGFPPLGAHGPFQPTASPVPPPLAGWMSSPSSVPHPAVSAGPIALGGPSIPAALKHPRTPPTNPALDYPSAESEHVSKRTRPMGISEEVSLGVNMLPMSFPGQAHGHSPAFKAPDDLPKTVARTLTQGSSPMSMDFHPIKQTLLLVGTNVGDIGLWEVGSRERLVQKTFKVWDISKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDNVQLLTAIDGDGGLQASPRIRFNKEGSLLAVSGNENVIKVMANSDGLRLLHTFENVSSESSKPAINSLAAAAAAAATSAAADRSANVVSIQAMNGDARNMVDVKPVITEESNDKSKIWKLTEVSEPSQCRSLRLPENLRVAKISRLIFTNSGNAILALASNAIHLLWKWQRNERNATGKATASLPPQQWQPASGILMTNDAAENNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNTAPSDTRVQFHQDQAHFLVVHETQLAIYETTKLECMKQWPVRESSAPITHATFSCDSQLVYASFMDATICVFSSANLRLRCRVNPSAYLPASLSNSNVNPLVIAAHPQEPNMFAVGLSDGGVHIFEPVESEGKWGVAPPAENGSANGAVAAPSVGASASDQPQR

SEQ ID NO: 15700 - protein, 1123 aa, Brassica napus
MSSLSRELVFLILQFLDEEKFKETVHKLEQESGFFFNMKYFEDEVHSGNWDEVEKYLSGFTKVDDNRYSMKIFFEIRKQKYLEALDKHDRPKAVEILVKDLRVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSQVPTPLAGWMSSSSSVPHPAVSGGAIALGSPSIQALKHPRTPPSNSAVEYPSGDSEHVSKRTRPMGISDEVNLGVNMLPMTFPGQAHGHTQAFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCFTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNVQLLTAIDADGGLQASPRIRFNKEGSLLAVSANDNMIKVMANTDGLRLLHTVDNLSSESSKPAINNIAVAERAAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTEANSEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLQVPQGRSTGALSDTRVQFHQDQVHFLVVHETQLAIYETTKLECMKQWPVRESSAPITHATFSCDSQLIYASFMDATICVFTSANLRLRCRVNPSAYLPASLSNSNVHPLVIAAHPQESNMFAVGLSDGGVHIFEPLESEGKWGVAPPPENGSSSALASTPSVGASASDQPQR

SEQ ID NO: 15701 - protein, 1128 aa, Silene vulgaris
LILQFLDEEKFKETVHKLEQESGFFFNMKYFEDEVHNGNWDEVEKYLSGFTKVDDNRYSMKIFFEIRKQKYLEALDRHDRSKAVDILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHTCGQPNGAQAPSTASNPLLGGLPKAGGFPPMGAHGPFQTTPGQVPAPLAGWMSNSPAVSHSPVPGGPIGLGGPSIPAAPKHPRTPPTNSSMDFPSGDSDHVPKRTRPLGIGDEVNLPVNVLPVSFPGHGYGQPFNIPDDLPKTVTRTLNQGSSPMSMDFHPVQLTLLLVGTNVGDIALWEVGSRERLVVKNFKVWDISTCSMSLQAALVKDPAVSVNRVIWSPDGSLFGVAYSRHIVQIYSYHGGEEVRQHLEIDAHIGGVNDIAFSTPNKQLCVITCGDDKTIKVWDAATGSKQHTFEGHEAPVYSVCPHYKESIQFIFSTAIDGKIKAWLYDNLGSRVDYDAPGRWCTTMAYSQDGTRLFSCGTSKDGESHIVEWNESEGAVKRTYLGFRKKSLGVIQFDTTKNRYLAAGDDFSIKFWDMDNVQLLTSIDAEGGLPASPRIRFNKDGTLLAISTSENGIKVLANSDGLRLLRTYETYDSSRAPESLTKPSINSISAAAAVAAAGVATSSGLPERGPPIVSMGGMNGDSRTLGDVKSRIIEESNDKSKIWKLTEINEPAQCRSSRLPEHMRAAKIARLIYTNSGNAILALASNAIHLLWKWQRNERNTSGKATASVSPQLWQPSSGILMTNDVSDASSEEAVPCFALSKNDSYVMSASGGKISLFNMMTFKTMTVFMPPPPAATFLAFHPQDNNIIAIGMDDSSIQIYNVRVDEVKSKLKGHSKRVTGLAFSHLLNVLVSSGADSQICVWSSDGWEKQRSKFLQLPQGRAPTSVSDTRVQFHQDQTHFLVVHETQLAIFETKQLDCVKQWVPHESSAPISHAAFSCDSQLVYASFLDATVCVFNSSNLRLRCRINPSAYLPASVSSSNVHPLVIAAHPQEANQFAVGLSDGGVHVFEPLESEAKWGTPPPLENGSGGSIPTTPSVGASASDQQQR

SEQ ID NO: 15702 - protein, 1130 aa, Brassica rapa
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVNNPLLGGIPKAGGFPPLGAHGPFQPTASPVPTPLAGWMSSPSSVPHPAVSAGPIALGGPSISAALKHPRTPPTALDYPSADSEHVSKRTRPMGISDEVSLGVNMLPMSFPGQAHGHSPAFKAPDDLPKTVARTLTQGSSPMSMDFHPIKQTLLLVGTNVGDIGLWEVGSRERLVQKTFKVWDISKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSICPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDNVQLLTAIDGDGGLQASPRIRFNKEGSLLAVSGNENVIKVMANSDGLRLLHTFENVSSESSKPAISSLAAAAAAAAATSAGLTDRPANVVSIQGMNGDSRNMVDVKPVITEEPNDKSKIWKLTEVSEPSQCRSLRLPENLRVAKISRLIFTNSGNAILALASNAIHLLWKWQRNDRNATGKATASLPPQQWQPASGILMTNDAAENNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLPLPQGRPNTAPSDTRVQFHQDQAHFLVVHETQLAIYETTKLECMKQWPVRESSAPITHATFSCDSQLVYASFMDATICVFSSANLRLRCRVNPSAYLPASLSNSNVHPLVIAAHPQEPNMFAVGLSDGGVHIFEPVESEGKWGVAPPAENGSASGAAAAPSVGASASDQPQR

SEQ ID NO: 15703 - protein, 1135 aa, Amorphophallus konjac
MSSLSRELVFLILQFLDEEKFKETVHKLEQESGFFFNMKYFEEEVHNGNWDEVEKYLSGFTKVDDNRYSMKIFFEIRKQKYLEALDKHDRAKAVDILIKDLKVFASFNEELFKEITQLLTLDNFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSIPKAGGFPPLGATHGPFQPTPAPVPTPLAGWMSSPPTATHAAVSGGTIGLGGAANQAILKHPRTPPSNNPAIDYPSADSDHVSKRTRPIGISDEVNLPVTILPVTYPGQNHNQAMYSPDDLPKTVARTLSQGSNPMSMDFHPIQQTILLVGTNVGDIALWDVGTRERLVLRNFKVWELGQCSVPLQTSLVKDPGVSVNRIIWSPDGSLFGVAYSRHIVQIYSYHGGDEIKPHLEIDAHVGGVNDLAFAHPNKQLCVITCGDDKTIKVWDATNGTKQYTFEGHEAPVYSVCPHHKENIQFIFSTALDGKIKAWLYDNMGSRVDYDAPGHWCTTMAYSADGSRLFSCGTSKEGESFIVEWNESEGAVKRTYQGFRKRSLGVVQFDTTRNRFLAAGDEFMIKFWDMDNVNLLTTVDAEGGLPASPRIRFNKEGALLAVSTNDNGIKILANAEGLRLLRTFENRSFDTSRPASETVTKPIISPMSAVGVATSAGITDRGASTVTMAGMNGDARNIDVKPRITEEPMDKSKIWKLTEINEPAQCRSLRLMDNLRASKISRLIYTNSGIALLALASNAIHLLWKWPRSDRNSSGKATASVQPQLWQPPSGILMTNDITDTNPEEAIPCFALSKNDSYVMSASGGKISLFNMMTFKTMTTFMPPPPAATFLAFHPQDNNIIAIGMDDSTIQIYNVRVDEVKSKLRGHSKRITGLAFSHVMNVLVSSGADAQLFVWGTDGWEKQRSRFLQIPAGRTPSANSETKVQFHQDQIHFLAVHETQLAIYETTKLECMKQYVPREPSAPITHATFSCDSQLIYASFLDATVCIFSAPHLTLRCRISPTSYLPANISSNVYPLVIAAHPSEPNQFALGLTDGGVHVLEPLESEGKWGVAPPAENGSASSLSVAPPAGASGSEQQQR

SEQ ID NO: 15704 - protein, 610 aa, Brassica napus
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVNNPLLGGIPKAGGFPPLGAHGPFQPTASPVQTPLAGWMSSPSSVPHPAVSAGAIALGGPSISAALKHPRTPPTALDYPSAESEHVSKRTRPMGISDEVSLGVSMLPMSFPGQAHGHSPAFKAPDDLPKTVARTLIQGSSPMSMDFHPIKQTLLLVGTNVGDIGLWEVGSRERLVQKTFKVWDISKCSMPLQAALVKEPVVSVNRVIWSPDGSLFGVTYSRHIVQLYSYHGGEDMRQHLEIDAHVGGVNDISFSTPNKQLCVITCGDDKTIKVWDAATGVKRHTFEGHEAPVYSICPHYKENIQFIFSTALDGKIKAWLYDNMGSRVDYDAPGRWCTTMAYSADGTRLFSCGTSKDGESYIVEWNESEGAVKRLTKDSTSVLLALCSLIRLKTVT

SEQ ID NO: 15705 - protein, 254 aa, Brassica napus
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVEILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVNNPLLGGIPKAGGFPFRRTWAISTNGLTRSNSSCWLDV

SEQ ID NO: 15706 - protein, 1092 aa, Flaveria ramosissima
FEDEVHNGNWDEVEKYLSGFTKVDDNRYSMKIFFEIRKQKYLEALDKHDRSKAVEILVKDLKVFASFNEDLFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPASNPLLGSLPKAGGFPPLGAHGPFQPTPAPVPAPLAGWMSNPPAVSHPTVSGSAIGLGSPSISAALKHPRPPTNSSLDYPSADADHMSKRTRPLGITDEVNLPVNVLPVSFPGHSGHSQAFNAPDDLPKTVARTLNQGSSPMSMDFHPIQQTLLLVGTNVGDVGLWEVGSRERLVLKNFKVWNLSACSMPLQAALVKDPGVSVNRVIWSPDGSLFGVAYSRHIVQIYSYHGGDDVRQSIEIDAHVGGVNDLAFSNPNKQLCVITCGDDKTIKVWDASNGVKKYTFEGHEAPVYSVCPHYKENIQFIFSTALDGKIKAWLYDNMGSRVDYEAPGRWCTTMAYSADGTRLFSCGTSKEGESHIVEWNESEGAVKRTYIGFRKRSLGVVQFDTTKNRYLAAGDDFAIKYWDMDNVQLLTSVDADGGLPASPRIRFNKDGALLAVSANDNGIKILANSDGLRLLRTFENLSFDGSASRTPEAAKPTVISLSPAAASSAALAERVASVGSISAMNGDARSLPDVKPRIVEETNDKSKIWKLSEINEASQCRSLKLPENMRVTKISRLIYTNSGNALLALASNAIHLLWKWQRNERNSSGKATAAVSPQLWQPSSGILMTNDVAETNPEESVACFALSKNDSYVMSASGGKISLFNMMTFKTMTTFMPTPPAATFLAFHPQDNNIIAIGMEDSTIQIYNVRVDEVKSKLRGHSKRITGLAFSHVLNVLVSSGADAQICVWSSDGWEKQKTRYVQLPPGRTPSPQSDTRVQFHHDQIHFLLVHETQLAIYEATKLECVKQWIQRENLAPISHATFSCDSQLVYASFFDATICVFTASNLRLRCKINPSAYLTGNLTVHPVVIAAHPQEPNQFALGLSDGTVHVLEPLESDGRWGVPPPADNGSTSTTPATPPAAGSGSEQTAQR

SEQ ID NO: 15707 - protein, 1099 aa, Eutrema parvulum
MSSLSRELVFLILQFLDEEKFKETVHKLEQESGFFFNMKYFEDEVHNGNWDEVEKYLSGFTKVDDNRYSMKIFFEIRKQKYLEALDKHDRPKAVDILVKDLKVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCGPPNGARAPSPVNNPLLGGLPKAGGFPPLGAHGPFQPTASPVPTPLAGWMSSPSSVPHPAVSAGAIALGGPSIPAALKHPRTPPTNAALDYPSAESEHVSKRTRPMGISDEVNLGVNMLPMSFPGQAHGHGPAFKAPDDLPKTVARTLTQGSSPMSMDFHPIKQTLLLVGTNVGDIGLWEVGSRERLVQKTFKVWDISKCSMPLQAALVKEPVVSVNRVIWSPDGSLFGVAYSRHIVQLYSYHGGEDMRQHLEIDAHVGGVNDISFSTPNKQLCVITCGDDKTIKVWDAATGVKRHTFEGHEAPVYSVCPHYKENIQFIFSTALDGKIKAWLYDNMGSRVDYDAPGRWCTTMAYSADGTRLFSCGTSKDGESYIVEWNESEGAVKRTYQGFHKRSLGVVQFDTTKNRYLAAGDDFSIKFWDMDTVQLLTAIDGDGGLQASPRIRFNKEGSLLAVSGNENVIKVMANSDGLRLLHTFENISSESSKNGDSRNMVDVKPVITEESNDKSKIWKLTEVSEPSQCRSLRLPENLRVAKISRLIFTNSGNAILALASNAIHLLWKWQRNDRNTTGKATASLPPQQWQPASGILMTNDAAENNPEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRNKVLPLPQGRPNTAPSDTRVQFHQDQAHFLVVHETQLAIYETTKLECMKQWPVRESSAPITHATFSCDSQLVYASFMDATICVFSSANLRLRCRVNPSAYLPASLSNSNVHPLVIAAHPQEPNMFAVGLSDGGVHIFEPVESEGKWGVAPPAENGSASGAVAAPSVGASASDQPQR

SEQ ID NO: 15708 - protein, 1134 aa, Musa acuminata
MSSLSRELVFLILQFLDEEKFKETVHKLEQESGFYFNMKYFEDEVHNGNWDNVERYLSGFTKVDDNRYSMKIFFEIRKQKYLEALDKHDRSKAVEILVKDLKVFASFNEELFKEITQLLTLENFRENEQLSKYGDTKSARTIMLVELKKLIEANPLFRDKLQFPNLKSSRLRTLINQSLNWQHQLCKNPRPNPDIKTLFVDHSCGQPNGALAPSPVNNSLLGSMPKAGGFPPLGAHGPFQPAPAPVPMPLAGWMSNPSAVTHPAVSGGAIGLNAPTNPVAILKHPRTPPTANPGIEYASADSDHVSKRTRPIGISDEVNLPVNILPVSYPQSHNQATYTLEDLPKTVARTLSQGSNPMSMDFHPVQQTILLVGTNVGDIALWDVGTRERLILKNFKVWELGSCSMSLQASLVKDPAVSVNRIIWSPDGSLFGVAYSRHIVQIYSYHGGDDIRQHLEIEAHVGGVNDIAFAYPSKQLSVITCGDDKTIKVWDATSGTKQYTFEGHEAPVYSVCPHHKENIQAFIFSTALDGKIKAWLYDNLGSRVDYDAPGHWCTTMAYSADGSRLFSCGTSKEGETFIVEWNESEGAVKRTYQGFRKRSLGVVQFDTTRNRFLAAGDEFLIKFWDMDNTNILTTVDADGGLPASPRIRFNKEGTLLAISTHDNGIKILANTDGLRLLRTLENRSFDASRTVSETVTKPVISPLSAAASAATSSGIITPPMAIAGMNGDSRNLVDAKPRITDESMDKSKIWKLTEVNEPTQCRSLRLVDNLRTSKISRLIYTNSGIAILALASNAIHLLWKWPRNERNSSGKATASVAPQLWQPPSGILMTNEITDTNPEEAVHCFALSKNDSYVMSASGGKISLFNMMTFKTMTTFMAPPPAATFLAFHPQDNNIIAIGMEDSTIQIYNVRVDEVKSKLRGHSKRITGLAFSNVLNVLVSSGADAQLCLWGTDGWEKHRSRFLQIPPGRTPAAISDTRVQFHQDQIHFLAVHETQIALYETTKLECVKQWAPREGSAPISHATFSCDSQLIYASFLDATICVFNATNFRLRCRILPAAYLPASVSTTLYPLVIAAHPSEPNQFALGLTDGGVHVLEPLESEGKWGVNPPTDNGSASSISAPLPAGASNSDQPQR

SEQ ID NO: 15709 - protein, 1126 aa, Elaeis guineensis
ILQFLDEEKFKETVHKLEQESGFYFNMKYFEDEVHNGNWDEVERYLSGFTKVDDNRYSMKIFFEIRKQKYLEALDKHDRAKAVDILVKDLKVFASFNEELFKEITQLLTLENFRENEQLSKYGDTKSARAIMLVELKKLIEANPLFRDKLQFPSLKSSRLRTLINQSLNWQHQLCKNPRPNPDIKTLFVDHSCGQPNGARAPSPANSPLLGSIPKAGGFPPLGTHGPFQPMPAPVPAPLAGWMSSPPAVTHPAVSGGAIGINTPTNPAAMLKHPRTPPTTNHAVDYPSADSDHVSKRTRPIGISDEVNLPINILPVTYPQNHSQAMYTLDDLPKTVARMLSQGSTPMSMDFHPIQQTILLVGTNVGDIGLWDVGTRERLVLRNFKVWELGACSVSLQASLVKDPSVSVNRVIWSSDGSLFGVAYSRYIIQIYSYHSGNDIRQHLEIDAHVGGVNDIAFAHPNKQLCIITCGDDKTIKVWDATTGTKLYTFEGHEAPVYSVCPHYKENIQFIFSTALDGKIKAWLYDNLGSRVDYDAPGHWCTTMAYSADGSRLFSCGTSKEGESFIVEWNESEGAVKRTYQGFRKRSLGVVQFDTTRNRFLAAGDEFLIKFWDMDNTNLLTTVDADGGLPASPRIRFNKEGTLLAVSTHDNGIKILANADGLRLLRTFENRSFETSRAISESVTKPIISPLSAAAAAVATSSGITERAAPAVAIAGMNGDNRNLVDVKPRLTDESMDKSKIWKLTEISEPTQCRSLRLIDNLRTSKISRLIYTNSGVAILALASNAIHLLWKWPRNERNSSGKATASVAPQLWQPPSGILMTNEITDTNPEEAVPCFALSKNDSYVMSASGGKISLFNMMTFKTMTTFMPPPPAATFLAFHPQDNNIIAIGMDDSTIQIYNVRVDEVKSKLKGHSKKVTGLAFSNVLNVLVSSGADAQICVWGTDGWEKQKSRLLQIPSGRTAFTISDTRVRFHHDQIHFLAVHETQIALYETTRLECLKQWVPREGSAPISHATFSCDSQFIYASFLDATICIFNAANFILRCRILPAAYLPANVSTTVYPLVVAAHPSEPNQFALGLTDGGVHVLEPLESEGKWGVAPPAENGSASSMSTPPPAGASSSDQPQR

SEQ ID NO: 15710 - protein, 1056 aa, Panax ginseng
IRKQKYLEALDKNDRSKAVEILVKDLKVFSSFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCAQPNGARAPSPANNPLLGSLPKAGVFPPLGAHGPFQPTGAPVPTPLAGWMSNPSAVTHPPVSGGAIGLGGPSMPAALKHPRTPPANPSLDYPSGDSDHVTKRTRPMGISDEVNLPINVLPVSFPGHTHSQAFNAPDDLPKSVARTLNQGSSPMSMDFHPIQQTLLLVGTNVGDIGLWEIGSRERLVLRNFKVWDLGACSMPLQAALVKDPGVSVNRVIWSPDGSLFGVAYSRHIVQIYSYHRGDDLRQHLEIDAHIGGVNDLAFSHPNKQLCVITCGDDKTIKVWDATTGAKQYTFEGHEAPVYSVCPHYKENIQFIFSTALDGKIKAWLYDNLGSRVDYDAPGRWCTTMAYSADGTRLFSCGTSKDGESHIVEWNESEGAVKRTYLGFRKRSLGVVQFDTTKNRFLAAGDEFSIKFWDMDNVQLLTSIDGDGGLPASPRIRFNKDGSLLAVSTNENGIKILANSDGLRLLRTFENQSYDASRAPETVKSSINTISAAASSSGLAERVVSTAALSGMNGDSRNLGDIKPRITEESNDKSKIWKLAEVNEPSQCRSMKLPENMRVTKISRLIYTNSGNAILALASNAIHLLWKWQRSDRNSSGKATASVSPQLWQPSSGILMTNDVTDTNPEDAVPCFALSKNDSYVMSASGGKISLFNMMTFKTMTTFMPPPPAATFLAFHPQDNNIIAIGMDDSTIQIYNVRVDEVKSKLKGHSKRITGLAFSHVLNVLVSSGADAQLCVWNSDGWEKQKSRYLQVPAGRTTTAQSDTRVQFHQDQMHFLVVHETQLAIYETIKLECVKQWVPRESSAPISHATFSCDSQLVYASFLDASLCVFSAAHLRLRCRINPLAYLSPSVSNSNIHPLVIAAHPQEPNQFALGLSDGGVHVFEPLESEGKWGVPQPVENGSASSVTTTPSVGASGSDQAQR

SEQ ID NO: 15711 - protein, 1118 aa, Eucalyptus grandis
MSSLSRELVFLILQFLDEEKFKETVHKLEQESGFYFNVRHFEDEVHNGNWDEVERYLSGFTKVDDNRYSMKIFFEIRKQKYLEALDKHDRSKAVDILIKDLKVFSTFNEELFREITQLLTLENFRENEQLSKYGDTKSARAIMLVELKKLIEANPLFRDKLQFPSLKNSRLRTLINQSLNWQHQLCKNPRSNPDIKTLFVDHSCGQPNGARAPSPANSPLLGPLPKVGGFPPLGAHGPFQPAPAAVPTPLAGWMSNPPSTVTHPVVPGGGVIGLGGPSIPGDASDPVSKRTRPLGIVDEVNLPVNVLPVTFPGHGHAPAFTSDDLPKAVGRILNPGSSPMSMDFHPVQQTLLLVGTNVGDISLWDVVSRERLLSKNFKVWDLSCCTTTLQAALVKDPGVSVNRIMWSPDGSLFGVAYSLHVVQLFSFNVNNEVRQHLEIDAHVGGVNDLAFAQPNKQLCVITCGDDKTIKVWDAVTGVKRHTFEGHEAPVYSVCPHSKENIQFIFSTALDGKIKAWLYDNMGSRVDYDAPGRWCTTMAYSADGTRLFSCGTSKDGESFIVEWNESEGAVKRTYQGFRKRSFGVIQFDTTRNRYLAAGDDFSIKVWDMDNVNLLTTLDADGGLTASPRVRFNKDGSLLAVSINENGIKILANSDGMRLLRTFENFSYDVSRTPETLVKPKVNPITATAATAPISAGLADRGAPAVVTSGMNGDARILGDVKPRITEESNEKSKLWKLTEISEPSLCRSLRLPENQRANKISRLIYTNSGSAILALASNAVHLLWKWQRNDRNSTGKATASVAPQQWQPSSGIVMTNDVNKNNPEEAVPCFALSKNDSYVMSASGGKISLFNMMTFKTMTTFMPPPPAATFLAFHPQDNNILAIGMDDSTVQIYNVRVDEVKSKLKGHSKRITGLAFSNTLNVLVSSGADAQICVWSSDVWEKQKSTYLQIPPGRTPGAQSDTRVQFHQDQMHFLAVHGTQLAVYEATKLECMKQWVPYESSAPISHATFSCDSQLVYASFFDASICVFNAANLRMQCRINPSAYLPATVSNSNVHPLVIAAHPHEPNQFALGLSDGGVHVFEPLDSHSRWGMPPPAENGSASGVSASSAGPSGSDHAER

SEQ ID NO: 15712 - protein, 992 aa, Cajanus cajan
MLVELKKLIEANPLFRDKLQFPNLKNSRLRTLINQSLNWQHQLCKNPRPNPDIKTLFVDHSCGQPNGARAPSPANNPLLGSLPKAGGFPPLGAHGPFQPTPAPVPTPLAGWMSNPTTVAHAAVSGGGAIGLGAPSIPASLKHPRTPPTNPSVDYPSGDSDHVAKRTRPMGISDEVNLPVNVLSATFPGHGQHSQAFNAPDDIPKAVVRTLNQGSSPMSMDFHPVQQSLLLVGTNVGDIALWEVGSRERLVSRNFKVWDLSACSMPFQAALVKDPGVSVNRVIWSPDGALFGVAYSRHIVQIYSYHGGEEIRHHLEIDAHVGGVNDLAFSHPNKQLCVITCGDDKTIKVWDAASGARQYIFEGHEAPVYSVCPHYKENIQFIFSTALDGKIKAWLYDNLGSRVDYEAPGRWCTTMAYSADGTRLFSCGTSKEGESSIVEWNESEGAVKRTYQGFRKRSLGVVQFDTTKNRFLAAGDDFSIKFWDMDNVQLLTTVDADGGLPASPRIRFNKDGTLLAVSANENGIKILANGDGIRLLRTLENSSYDASRQPEVLAKPTINPISAAAAAATSAALAERASSVVAIAGMNGDTRNLGDVKPRISEESNDKSKIWKLTEINEPSQCRSLKLPENVRVNKISRLIYTNSGNAILALASNAIHLLWKWQRSERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPPGRTPPAQSDTRVQFHLDQLQFLVVHETQLAIYEATKLDGLKQWFTRDSSAPISHATYSCDSQLIYASFLDATICVFSASNLRLRCRINPSSYLPSSVSSNVQPLVIAAHPQEPNQFAVGLSDGGVHVFEPLESEGKWGVPPPIENGSASNVAATSVGPSSDQAQR

SEQ ID NO: 15713 - protein, 1089 aa, Brassica rapa
MSSLSRELVFLILQFLDEEKFKETVHKLEQESGFFFNMKYFEDEVHSGNWDEVEKYLSGFTKVDDNRYSMKIFFEIRKQKYLEALDKHDRPKAVEILVKDLRVFSTFNEELFKEITQLLTLENFRENEQLSKYGDTKSARSIMLVELKKLIEANPLFRDKLQFPTLRNSRLRTLINQSLNWQHQLCKNPRPNPDIKTLFVDHSCRLPNDARAPSPVNNPLLGSLPKAGGFPPLGAHGPFQPTPSQVPTPLAGWMSSSSSVPHPAVSGGAIALGSPSIQAALKHPRTPPSNSAVEYPSGDSEHVSKRTRPMGISDEVNLGVNMLPMTFPGQAHGHTQAFKAPDDLPKTVARTLSQGSSPMSMDFHPIKQTLLLVGTNVGDIGLWEVGSRERLVQKTFKVWDLSKCSMPLQAALVKEPVVSVNRVIWSPDGSLFGVAYSRHIVQLYSYHGGEDMRQHLEIDAHVGGVNDIAFSTPNKQLCFTTCGDDKTIKVWDAATGVKRHTFEGHEAPVYSICPHYKENIQFIFSTALDGKIKAWLYDNMGSRVDYEAPGRWCTTMAYSADGTRLFSCGTSKDGDSYIVEWNESEGAVKRTYQGFHKRSLGVVQFDTTKNRYLAAGDDFSIKFWDMDNVQLLTAIDADGGLQASPRIRFNKEGSLLAVSANDNMIKVMANTDGLRLLHTVDNLSSESSKPAINNIAVAERAAERPASVVSIPGMNGDSRNMVDVKPVITEESNDKSKIWKLTEVGEPSQCRSLRLPENMRVTKISRLIFTNSGNAILALASNAIHLLWKWQRNDRNATGKATASLPPQQWQPASGILMTNDVTEANSEEAVPCFALSKNDSYVMSASGGKISLFNMMTFKTMATFMPPPPAATFLAFHPQDNNIIAIGMDDSTIQIYNVRVDEVKSKLKGHSKRITGLAFSNVLNVLVSSGADAQLCVWNTDGWEKQRSKVLQVPQGRSTGALSDTRVQFHQDQVHFLVVHETQLAIYETTKLECMKQWPVRESSAPITHATFSCDSQLIYASFMDATICVFTSANLRLRCRVNPSAYLPASLSNSNVHPLVIAAHPQESNMFAVGLSDGGVHIFEPLE

SEQ ID NO: 15714 - protein, 1145 aa, Musa acuminata
MSSLSRELVFLILQFLDEEKFKETVHKLEQEAGFYFNMKYFEDEVHNGNWDNVERYLSGFTKVDDNRYSMKIFFEIRKQKYLEALDKHDRAKAVEILVKDLKVFASFNEELFKEITQLLTLENFRENEQLSKYGDTKSARTIMLVELKKLIEANPLFRDKLQFPNLKSSRLRTLINQSLNWQHQLCKNPRPNPDIKTLFVDHSCGQPNGALAPSPANNPLLGSMPKAGGFPPLGTHAPFQPVPAPVPTPLAGWMSNPSAVTHPVVSGAAIGLNAPTNPGSVVDSVIAVAILKHPRTPPTANPSIEYSSADSDHVSKRTRPIGISDEVNLPVNILPVSYPQNHNQATYTIEDLPKTVARTLSQGSNPMSMDFHPLQRTILLVGTNVGDIALWDVGTRERLIHKNFKVWELGTCSMSLQASLVKDPAVSVNRIIWNPDGSLFGVAYSRHIVQIYSYHGSDDIRQHLEIDAHVGGVNDIAFAHPSKQLSFITCGDDKTIKVWDATSGTKQYTFEGHGAPVYSVCPHHKENIQFIFSTALDGKIKAWLYDNLGSRVDYDAPGHWCTTMAYSADGSRLFSCGTSKEGETFIVEWNETEGAVKRTYQGFRKRSLGVVQFDTTRNRFLAAGDEFLIKFWDMDNTNLLTTIDADGGLPASPRIRFNKEGTLLAVSTHDNGIKILANADGIRLLRTLENRSFDASRTVSETITKPMMSPLSAAAVATTSGITDRTAPSMPISGMNGDGRNLVDVKPRITDESMDKSKIWKLTEINEPTQCRSLRLMDNLRTSKISRLIYTNSGAAILALASNAIHLLWKWPRNERNSSGKATASVAPQLWQPPSGILMTNEITDTNPDEVVHCFALSKNDSYVVSASGGKISLFNMMTFKTMTTFMPPPPTATFLAFHPLDNNIIAIGMDDSTIQIYNVRVDEVKRKLRGHSKRITGLAFSNALHVLVSSGADAQLCVWGTEGWEKQRSRFLQIQSARTPSTISDTRVQFDQDQIHFLAVHETQIAIYETTKLECVKQWSPREGSAPISHATFSCDSQSIYASFLDATVCIFNAANLKLRCRILPAAYLPASVSTNVHPLVIAAHPSEPNQFALGLTDGGVHVVKPLESEGKWGVNPPAENGSASSLSAPPTTAGPSSSDQPQR

SEQ ID NO: 15715 - protein, 1129 aa, Setaria italica
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSIPKPGGFPPLGAHGPFQPAPTPVPPLAGWMSNPPAVTHPAVSGGAIGFGTPTNPAALLKHPRTPTTANPSMDYPSGDSDHVSKRSRPVGMAEEVNLPVNMLPVTYPQSHNYQQEDFHKTVARTLNQGSAPMSMDFHPLQQTLLLVGTNVGDIGLWDVGTKDRLALRNFKVWELGKCSMTLQASLVKDPAVSVNRIIWSPDGTLFGVAYSRHIVQIYSYNGGDDIRQHLEIDAHVGGVNDIAFAHPNKQLCIITCGDDKTIKVWEATSGAKQFSFEGHEAPVYSVCPHYKENIQFIFSTALDGKIKAWLYDNLGSRVDYDAPGHWCTTMAYSADGSRLFSCGTSKEGESHLVEWNESEGAVKRTYQGFRKRSMGVVQFDTTRNRFLAAGDEFMVKIWDMDNTGLLTTIDADGGLPASPRIRFNKEGTLLAVSTLDNGVKILANADGLRLLRTLENRSFDASRNATETVTKPLINPLTAAANAAAASSSGTPAPAAITAMNGDTRGLVDVKPRITDESLDKSKVWKLMEITESTQCRSIKLADNMRASKISRLIYTNSGVAILALTASAVHLLWKWPRSDRNSSGKATASVSPQLWQPPSGIFMTNDMTDNNPEDAVHCFALSKNDSYVMSASGGKISLFNMMTFKTMTTFMPPPPAATFLAFHPQDNNIIAIGMDDSTIQIYNVRIDEVKSKLRGHSKRITGLAFSNVLNVLVSSGADAQLCVWNTDGWEKQKNRFLQIPSGRPSNILDTRVQFHQDQMHFLVVHETQIAIYETTKLEPVKQWPVRENSPPITHATFSCDSQLIYASFMDATVGIFNASSLRLQCRILPASYLPPSISSSVHPVVVAAHPSEASQFALGLTDGGVYVLEPLESERKWGNPPPAENGSTSNLSTPPPNGASSSDQPER

SEQ ID NO: 15716 - protein, 1125 aa, Sorghum bicolor
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGSMPKPGGFPPLGAHGPFQPAPTPVPPLAGWMSNPPAVTHPAVSGGAIGFGTPTNPAALLKHPRTPTTANPGMDYPSGDSDHISKRTRPVGMSEEVNLPVNMLPVTYPQSHNYQQDDFHKTVARTLTQGSTPMSMDFHPLQQTLLLVGTNVGDIGLWDVGTKERLVVRNFKVWDLSKCTMTLQASLVKDPAVSVNRIIWSPDGTLFGVAYSRHIVQIYSYNGGDDLRQHLEIDAHIGGVNDIAFAHPNKQLCIITCGDDKTIKVWEATSGTKQFTFEGHEAPVYSVCPHYKENIQFIFSTALDGKIKAWLYDNLGSRVDYDAPGHWCTTMAYSADGSRLFSCGTSKDGESHLVEWNESEGAVKRTYQGFRKRSMGVVQFDTTRNRFLAAGDEFMIKIWDMDSTGLLTTIDADGGLPASPRIRFNKEGTLLAVSTLDNGIKILANADGLRLLRTLENRSFDASRNATETVTKPLILTAANAAAASSSVAAAPSAITAMNGDSRSLVDVKPRIADESLDKSKVWKLMEITESTQCRSIKLADNMRTSKISRLIYTNSGLAILALTSSAVHLLWKWPRSDRNSGKATASVSPTLWQPPSGIFMTNDTTDNNPEEAVHCFALSKNDSYVMSASGGKISLFNMMTFKTMTTFMPAPPAATFLAFHPQDNNIIAIGMDDSTIQIYNVRIDEVKSKLRGHSKRITGLAFSNVLNVLVSSGADAQLCVWNTDGWEKQKTRFLQIPSGRQSNILDTRVQFHQDQMHFLVVHETQIAIYETTKLEPVKQWPVRENSPPITHATFSCDSQLIYASFMDATVGIFNASSLRLQCRILPASYLPPNISPSVHPVVVAAHPSEASQFALGLTDGGVFVLEPLESERKWGNPPPVENGSASNLSTPPPNGASSSDQPER

SEQ ID NO: 15717 - protein, 1134 aa, Triticum aestivum
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKSSRLRTLINQSLNWQHQLCKNPRPNPDIKTLFVDHSCGQPNGARAPSPANNPLLGSIPKPGGFPQLGAHGPFQPAPTPVAPLAGWMSNPPAVTHPAVSGGAIGFGTPTNPAAMLKHPRTPSAANPSMDYPSGDSDHVSKRPRPVGLSEEVNLPVNMMPVTYPQSHSYPQDDFHKAVARTLSQGSAPMSMDFHPVQQTLLLVGTNVGDIGLWDVGTKERLVVRNFKVWELGKCSMALQAALVKDPTVSVNRIIWSPDGTLFGVAYSRHIVQIYSYHGGDDIRQHLEIDAHVGGVNDIAFAHPNKQLCIITCGDDKTIKVWEATSGTKQFTFEGHEAPVYSVCPHYKENIQFIFSTALDGKIKAWLYDNLGSRVDYDAPGHWCTTMAYSADGSRLFSCGTSKEGESHLVEWNESEGAVKRTYQGFRKRSMGVVQFDTTRNRFLAAGDEFVIKIWDMDNTSLLTTIEADGGLPASPRIRFNKEGTLLAVSTVDNGIKVLANADGVRLLRTLENRSFDASRSASETVTKPLINPLTAAAAAAAAAAAATSSGTAAPSSITAMNGDNRSMVDVKPRIADESMDKSKVWKLMEITDTAQCRSLKLGDSIRTAKISRLIYTNSGVAILALASNAVHLLWKWPRNERNSTGKATASVSPQLWQPPSGILMTNDTIDNSPDEAVHCFALSKNDSYVMSASGGKISLFNMMTFKTMTTFMPPPPAATFLAFHPQDNNIIAIGMDDSTIQIYNVRIDEVKSKLRGHSKKITGLAFSNVLNVLVSSGADAQICVWNTDGWERQRSRFLQIPSGRPTSNILDTRVQFHQDQQHCLVVHETQIAIYDASKLEPVKQWPPRETSAPPITHATFSCDSQLIYASFLDATVCIFSASSLRLQCRILPASYLPQNISSNVHPVVVAAHPSEANQFALGLTDGSVYVMEPLESERKWGIPPPAENGSTSNMSTPPNGASSSDQPER

SEQ ID NO: 15718 - protein, 1134 aa, Triticum aestivum
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKSSRLRTLINQSLNWQHQLCKNPRPNPDIKTLFVDHSCGQPNGARAPSPANNPLLGSIPKPGGFPQLGAHGPFQPAPTPVAPLAGWMSNPPAVTHPAVSGGAIGFGTPTNPAAMLKHPRTPSAANPSMDYPSGDSDHVSKRPRPVGLSEEVNLPVNMMPVTYPQSHSYPQDDFHKAVARTLSQGSAPMSMDFHPVQQTLLLVGTNVGDIGLWDVGTKERLVVRNFKVWELGKCSMALQAALVKDPTVSVNRIIWSPDGTLFGVAYSRHIVQIYSYHGGDDIRQHLEIDAHVGGVNDIAFAHPNKQLCIITCGDDKTIKVWEATSGTKQFTFEGHEAPVYSVCPHYKENIQFIFSTALDGKIKAWLYDNLGSRVDYDAPGHWCTTMAYSADGSRLFSCGTSKDGESHLVEWNESEGAVKRTYQGFRKRSMGVVQFDTTRNRFLAAGDEFVIKIWDMDNTSLLTTIEADGGLPASPRIRFNKEGTLLAVSTVDNGIKVLANADGVRLLRTLENRSFDASRSASETVTKPLINPLTAAAAAAAAAAAATSSGTAAPSPITAMNGDNRSLVDVKPRIADESMDKSKVWKLMEITDTAQCRSLKLGDSIRTAKISRLIYTNSGVAILALASNAVHLLWKWPRNERNSTGKATASVSPQLWQPPSGILMTNDTIDNSPDEAVHCFALSKNDSYVMSASGGKISLFNMMTFKTMTTFMPPPPAATFLAFHPQDNNIIAIGMDDSTIQIYNVRIDEVKSKLRGHSKKITGLAFSNVLNVLVSSGADAQICVWNTDGWERQRSRFLQIPSGRPTSNILDTRVQFHQDQQHCLVVHETQIAIYDASKLEPVKQWPPRETSAPPITHATFSCDSQLIYASFLDATVCIFSASSLRLQCRILPASYLPQNISSNVHPVVVAAHPSEANQFALGLTDGSVYVMEPLESERKWGIPPPAENGSTSNMSTPPNGASSSDQPER

SEQ ID NO: 15719 - protein, 125 aa, Glycine max
MAGRFRELMKKYGKVALGVHLSVSTVSITGLYVAIRNNVDVEAILEKLHMGTVSEEQNPNPNPSDDVAAPPKNRTAQLAASAGGAFTLAILCNKALFPVRVPITVALTPPIARFLARRKIIKTGL

SEQ ID NO: 15720 - protein, 127 aa, Vigna unguiculata
MAGGRFRELMKKYGKVALGVHLSVSTVSITSLYVAIKNNVDVEAILEKFHMGAVSDQENPNPNPIDEDASQPPKNRTAQVAASAGGAFTLAILCNKALFPVRVPITVALTPPIARFLARRNIIKSGV

SEQ ID NO: 15721 - protein, 129 aa, Glycyrrhiza uralensis
MAAGGRFRELMNKYGKVALGVHLSVSAASITGLYVAIRNNVDVESILEKFHMGTSVTPEENPNPSSDPDPSAAPVKNRTAQMAASAGGAFALAILCNKALFPVRVPITVALTPPISRFLARRNIVKTGV

SEQ ID NO: 15722 - protein, 125 aa, Phaseolus vulgaris
MAGGRFRELMKKYGKVAIGVHVSVSAVSIGGLYVAIKNNVDVEAILEKFHMGAASDQQNPNPTDEGASPPPNNKTAQLAASAGGAFTLAILCNKALFPLRVPITVALTPPVARFLARRNIVKSGV

SEQ ID NO: 15723 - protein, 717 aa, Sorghum bicolor
MRALASPTASFLPGIPSPSPRARGALRSAPAALSRAPSGRSVAASAAAATGDHWGADHQHYHGGRAGASEAGSAASARGVKCDVDVVSWRERRVLASVPVAADVDTLWQVITDYERLADFIPNLVQSGTIPCPHEGRIWLEQRGLQQALYWHIEARVVLDLQEIHDSINGRELHFSMVDGDFKKFEGKWSIRSGPRSSSAVLLYEVNVIPRFNFPAIFLEKIIRSDLPVNLGALACRAEKIYLENQSCGSRKFSVEDLKPSSTSSQLDNFRSRTVDTSSSKFKEAPPTSGVNSVLPSPASELISKWGVYGNVCRIDRPCVVDEIHLRRFDGMLEHEGAHRCVFASITVKAPVREVWNVLTAYENLPEFVPNLAISRIVLRDNNKVRIMQEGCKGLLYMVLHARVVMDLREKFEQEIRFEQVEGDFYSFKGKWRLEQLGDQHTLLKYMVETKMHRDTFLSESILEEVIYEDLPSNLCAIRDYIEKAGAKGSNSTAHSDVSIDPDAYHAESRQSEQASVSCSSSTMKQRPKVPGLQKDIEVLKSELENFIAEYGQYGFMPKRKHLRSHGRVDIEKAITRMGGFRKIASIMNLSLSYKNRKPRGYWDNLENLQEEISRFQKSWGMDPSYMPSRKSFERAGRYDIARALEKWGGVQEVSRLLSLKLRRPRRQGDLDDESRSESPSEMTKKHGVKPDKGNVSPDAQKWLLKLKDLDVNWVEY

SEQ ID NO: 15724 - protein, 715 aa, Panicum virgatum
MRALASPAASILNPGASPNPRAPLRSAAAPLPRGPCPGRSVAAAAAAATGDHWGADHHHVCGRATSPEAGARAAHGVKCDVDVVSWRERRVLASVPVAADVDTLWQVITDYERLADFIPNLVQSVRIPCPHEGRIWLEQRGLQRALYWHIEARVVLDLQEVPDSVNGRELHFSMVDGDFKKFEGKWSIRSGPRSSSAVLLYEVNVIPRFNFPAIFLERIIRSDLPVNLRALASRAEKIYLENQRCGSRKFSAMDSKPSSTSSQLKFHSTAIETTSSKFKEAPPTAGVSSVLPSPSSELISKWGVYGNACRIDRPCVVDEIHLRRFDGLLEHEGAHRCVFASITVKAPVREVWNVLTAYENLPEFVPNLAISRIVLRDNNKVRLMQEGCKGLLYMVLHARVVMDLREKLEQEISFEQVEGDFYSFKGKWRFEQLGDHHTLLKYMVETKMHKDTFLSESILEEVIYEDLPSNLCAIRDYIEKAGAEGSNSITHSDAPTHSDIVPAQSRQLEQESASCSFSSTKQRPKVPGLQKDIQVLKSELENFIASYGQDGFMPKRKHLRSHGRVDIEKAITRMGGFRKIASIMNLSLSYKNRKPRGYWDNLENLQEEISRFQKSWGMDPSYMPSRKSFERAGRYDIARALEKWGGVQEVSRLLSLELRRPRMRADSDDERQSESQAGSGMTKKHGIKPDKANMSPDAQKWLLKLKDLDVNWVEY

SEQ ID NO: 15725 - protein, 717 aa, Setaria italica
MRALSSPAASFLPGILNPSANPNPRAPLRSAVAALSRGPCPSGRSVAAAAAAATGDHWGADHYHGGGHASSQEAAARAAHGVKCDVDVVSWRERRVLGSVAVAADVDTLWQVITDYERLADFIPNLVQSGRIPCPHEGRIWLEQRGLQQALYWHIEARVVLDLQEVPDSINGRELHFSMVDGDFKKFEGKWSIRSGPRSSSAILLYEVNVIPRFNFPAIFLERIIRSDLPVNLRALACRAEKIYLENQRCGFSAVDSKPSSTSSQLKFHSSTIDTTSSKFKEAPPTSGVGSVLPSPSSELIGKWGVYGNTCRIDRPCVVDEIHLRRFDGLLEHEGAHRCVFASITVKAPVREVWNVLTAYENLPEFVPNLAISRIVLRDNNKVRIMQEGCKGLLYMVLHARVVMDLREKLEEEISFEQVEGDFYSFKGKWRFEQLGDQHTLLKYMVETKMHKDTFLSESILEEIIYEDLPSNLCAIRDYIEKAGAEGSNSTTHSAAPTHPDIDHAEDRQSEKESASCSFSSMKQRPKVPGLQKDIEVLKSELENFIAKYGQDGFMPKRKHLRSHGRVDIEKAITRMGGFRKIASTMNLSLSYKNRKPRGYWDNLENLQEEISRFQKSWGMDPSYMPSRKSFERAGRYDIARALEKWGGVQEVSRLLSLELRRPRRQADSDDERQSESPAGSGITKQHGMKPDKANTSLDAHKWLLKLKDLDVNWVEY

SEQ ID NO: 15726 - protein, 188 aa, Sorghum bicolor
MKHLVLPSPLPLLLHRPTKPHLLHPRRRLVSIRNAASGGSSGEPTPAADTATGTSPPAGATAKPAGVKDRLKARNQSRRVQLDSPPPEVVVVPKRKPAASSSSSSSSPAPKRKERRKEWEEMSVGEKAAELYVGEKGLLFWLNKFAYASIFIMVGAWILFRFVGPSIGLYQLDAPPLPPTAVFGGGSP

SEQ ID NO: 15727 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 15728 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 15729 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 15730 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 15731 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 15732 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 15733 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 15734 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 15735 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 15736 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 15737 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 15738 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 15739 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 15740 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 15741 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 15742 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 15743 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 15744 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 15745 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 15746 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 15747 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 15748 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 15749 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 15750 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 15751 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 15752 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 15753 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 15754 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 15755 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 15756 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 15757 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 15758 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 15759 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 15760 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 15761 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 15762 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 15763 - DNA, 538 bp, 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 15764 - DNA, 555 bp, Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 15765 - DNA, 33 bp, Artificial Sequence
  Primer
aaaaggcctaacaggttcacattaaaggaatgc

SEQ ID NO: 15766 - DNA, 32 bp, Artificial Sequence
  Primer
aaaaggcctaatcaccactgtccgttgttaag

SEQ ID NO: 15767 - DNA, 31 bp, Artificial Sequence
  Primer
aaaaggcctaatgcatttaacgctgtccatc

SEQ ID NO: 15768 - DNA, 31 bp, Artificial Sequence
  Primer
aaaaggcctacatagcgcgaacagagcttac

SEQ ID NO: 15769 - DNA, 31 bp, Artificial Sequence
  Primer
aaaaggcctacatcatcttctctttgcccag

SEQ ID NO: 15770 - DNA, 30 bp, Artificial Sequence
  Primer
aaaaggcctaccacaagaccaagtcaatgg

SEQ ID NO: 15771 - DNA, 31 bp, Artificial Sequence
  Primer
aaaaggcctagcgtctctgattaacggtcac

SEQ ID NO: 15772 - DNA, 31 bp, Artificial Sequence
  Primer
aaaaggcctagctttcaagcagacaacgagt

SEQ ID NO: 15773 - DNA, 31 bp, Artificial Sequence
  Primer
aaaaggcctaggaagttccctttccaatcac

SEQ ID NO: 15774 - DNA, 35 bp, Artificial Sequence
  Primer
aaaaggcctatcaataaattaatcaacttggctgc

SEQ ID NO: 15775 - DNA, 34 bp, Artificial Sequence
  Primer
aaaaggcctatgaaagcgaagtgtagaatctgtc

SEQ ID NO: 15776 - DNA, 31 bp, Artificial Sequence
  Primer
aaaaggcctattcccagccaacagtaacaac

SEQ ID NO: 15777 - DNA, 31 bp, Artificial Sequence
  Primer
aaaaggcctcaacaatatcgagcaccacaag

SEQ ID NO: 15778 - DNA, 31 bp, Artificial Sequence
  Primer
aaaaggcctcatccacgtgtttccatgttac

SEQ ID NO: 15779 - DNA, 31 bp, Artificial Sequence
  Primer
aaaaggcctcattcaaatttgtgtgcaatgg

SEQ ID NO: 15780 - DNA, 31 bp, Artificial Sequence
  Primer
aaaaggcctccatatcgcaaaagctaaatcc

SEQ ID NO: 15781 - DNA, 31 bp, Artificial Sequence
  Primer
aaaaggcctcccggaaagttatggttagtcc

SEQ ID NO: 15782 - DNA, 34 bp, Artificial Sequence
  Primer
aaaaggcctcctttcatgtacaatcagaacttgc

SEQ ID NO: 15783 - DNA, 31 bp, Artificial Sequence
  Primer
aaaaggcctcgattgctccatttacgttttc

SEQ ID NO: 15784 - DNA, 31 bp, Artificial Sequence
  Primer
aaaaggcctcgccaactatcgatgattacag

SEQ ID NO: 15785 - DNA, 32 bp, Artificial Sequence
  Primer
aaaaggcctctaacactgaaccggactgaacc

SEQ ID NO: 15786 - DNA, 34 bp, Artificial Sequence
  Primer
aaaaggcctctatacaacacactgaaccggactg

SEQ ID NO: 15787 - DNA, 34 bp, Artificial Sequence
  Primer
aaaaggcctctatcttgctccaaaccaagaacac

SEQ ID NO: 15788 - DNA, 34 bp, Artificial Sequence
  Primer
aaaaggcctctattccttcatggagaaaccaaac

SEQ ID NO: 15789 - DNA, 31 bp, Artificial Sequence
  Primer
aaaaggcctctgaaccagcatagtctccctc

SEQ ID NO: 15790 - DNA, 31 bp, Artificial Sequence
  Primer
aaaaggccttaagcaattaacgaatcccgac

SEQ ID NO: 15791 - DNA, 30 bp, Artificial Sequence
  Primer
aaaaggccttgcatcttgtcaaagaattgc

SEQ ID NO: 15792 - DNA, 33 bp, Artificial Sequence
  Primer
aaaaggccttgggtgaatcataggatacctttc

SEQ ID NO: 15793 - DNA, 33 bp, Artificial Sequence
  Primer
aaaaggcctttaatgctattcggtgctgtttga

SEQ ID NO: 15794 - DNA, 33 bp, Artificial Sequence
  Primer
aaaaggcctttatatgacgtagtttgcttggca

SEQ ID NO: 15795 - DNA, 32 bp, Artificial Sequence
  Primer
aaaaggcctttcgggtccacattagttacttg

SEQ ID NO: 15796 - DNA, 31 bp, Artificial Sequence
  Primer
aaaaggcctttgtgaatgaagttgctgaacc

SEQ ID NO: 15797 - DNA, 30 bp, Artificial Sequence
  Primer
aaacccgggagctaccctccaagcaaactg

SEQ ID NO: 15798 - DNA, 30 bp, Artificial Sequence
  Primer
aaacccgggataaacccttgacgacgtttg

SEQ ID NO: 15799 - DNA, 31 bp, Artificial Sequence
  Primer
aaacccgggcatcttgaacaacggatctgag

SEQ ID NO: 15800 - DNA, 31 bp, Artificial Sequence
  Primer
aaacccgggtatacacctccaagcctccaac

SEQ ID NO: 15801 - DNA, 31 bp, Artificial Sequence
  Primer
aaacccgggtcgtgtatctctccgataaacc

SEQ ID NO: 15802 - DNA, 30 bp, Artificial Sequence
  Primer
aaactcgagaaactgactgcgatgaacctg

SEQ ID NO: 15803 - DNA, 31 bp, Artificial Sequence
  Primer
aaactcgagaaatgatttggctagcgttcac

SEQ ID NO: 15804 - DNA, 32 bp, Artificial Sequence
  Primer
aaactcgagaactttgagaatgagaatggcag

SEQ ID NO: 15805 - DNA, 31 bp, Artificial Sequence
  Primer
aaactcgagacacgcaacccatttctgttac

SEQ ID NO: 15806 - DNA, 31 bp, Artificial Sequence
  Primer
aaactcgagaccctaaacaccaaacttcacg

SEQ ID NO: 15807 - DNA, 26 bp, Artificial Sequence
  Primer
aaactcgagaccttgccatggcgatg

SEQ ID NO: 15808 - DNA, 35 bp, Artificial Sequence
  Primer
aaactcgagactctatccaaatactaaaccgaacg

SEQ ID NO: 15809 - DNA, 31 bp, Artificial Sequence
  Primer
aaactcgagactgcggatgtatttatcgacg

SEQ ID NO: 15810 - DNA, 31 bp, Artificial Sequence
  Primer
aaactcgagagcgatcatatcttcacacgac

SEQ ID NO: 15811 - DNA, 31 bp, Artificial Sequence
  Primer
aaactcgagagtgtggaggatcgtcttcttc

SEQ ID NO: 15812 - DNA, 31 bp, Artificial Sequence
  Primer
aaactcgagatttcaatgacaatgacggaac

SEQ ID NO: 15813 - DNA, 32 bp, Artificial Sequence
  Primer
aaactcgagatttctaactgctcacaccaacg

SEQ ID NO: 15814 - DNA, 33 bp, Artificial Sequence
  Primer
aaactcgagcaaatccaattgactaatccttgc

SEQ ID NO: 15815 - DNA, 31 bp, Artificial Sequence
  Primer
aaactcgagcaagtggcagtaagacgaacag

SEQ ID NO: 15816 - DNA, 32 bp, Artificial Sequence
  Primer
aaactcgagcaatttaatttcgaaccacagac

SEQ ID NO: 15817 - DNA, 26 bp, Artificial Sequence
  Primer
aaactcgagcactgcaatggccatgg

SEQ ID NO: 15818 - DNA, 33 bp, Artificial Sequence
  Primer
aaactcgagcatgcaaatccaattgactaatcc

SEQ ID NO: 15819 - DNA, 30 bp, Artificial Sequence
  Primer
aaactcgagcattgctttggtttgcttcac

SEQ ID NO: 15820 - DNA, 31 bp, Artificial Sequence
  Primer
aaactcgagccaacaaaccaacagatccttc

SEQ ID NO: 15821 - DNA, 28 bp, Artificial Sequence
  Primer
aaactcgagccacctgctaagccgaatc

SEQ ID NO: 15822 - DNA, 31 bp, Artificial Sequence
  Primer
aaactcgagccagtggtcgtattacatgctg

SEQ ID NO: 15823 - DNA, 31 bp, Artificial Sequence
  Primer
aaactcgagccatcgctagtagttgagggag

SEQ ID NO: 15824 - DNA, 33 bp, Artificial Sequence
  Primer
aaactcgagcccaacatattacccaataagctt

SEQ ID NO: 15825 - DNA, 31 bp, Artificial Sequence
  Primer
aaactcgagcctaagttgcaaccatgggtat

SEQ ID NO: 15826 - DNA, 31 bp, Artificial Sequence
  Primer
aaactcgagcctggagattctttctttgacg

SEQ ID NO: 15827 - DNA, 31 bp, Artificial Sequence
  Primer
aaactcgagcgaattcaaagttctgtgggac

SEQ ID NO: 15828 - DNA, 31 bp, Artificial Sequence
  Primer
aaactcgagcggacatcttgaaatggaagtc

SEQ ID NO: 15829 - DNA, 32 bp, Artificial Sequence
  Primer
aaactcgagcgttctcaaggacatcataccac

SEQ ID NO: 15830 - DNA, 35 bp, Artificial Sequence
  Primer
aaactcgagctaaaggtgaagtacgtagcaggagc

SEQ ID NO: 15831 - DNA, 31 bp, Artificial Sequence
  Primer
aaactcgagctacatggaacgaagcagcaag

SEQ ID NO: 15832 - DNA, 35 bp, Artificial Sequence
  Primer
aaactcgagctatcaatttacagaaagacccgacc

SEQ ID NO: 15833 - DNA, 32 bp, Artificial Sequence
  Primer
aaactcgaggaaacgtaatcaacatttcgcag

SEQ ID NO: 15834 - DNA, 30 bp, Artificial Sequence
  Primer
aaactcgaggaatggcatttcagactaagc

SEQ ID NO: 15835 - DNA, 34 bp, Artificial Sequence
  Primer
aaactcgaggaattgttcaaacttcagacagagc

SEQ ID NO: 15836 - DNA, 27 bp, Artificial Sequence
  Primer
aaactcgaggagagccatggcgacaac

SEQ ID NO: 15837 - DNA, 33 bp, Artificial Sequence
  Primer
aaactcgagggtatacaagcaataaccggaaac

SEQ ID NO: 15838 - DNA, 37 bp, Artificial Sequence
  Primer
aaactcgaggttagggataagtataagccgtaaaaga

SEQ ID NO: 15839 - DNA, 27 bp, Artificial Sequence
  Primer
aaactcgaggttttcgtggtcgggatg

SEQ ID NO: 15840 - DNA, 30 bp, Artificial Sequence
  Primer
aaactcgagtaaacacattcaaactgcgcc

SEQ ID NO: 15841 - DNA, 38 bp, Artificial Sequence
  Primer
aaactcgagtaagaaatagatatcaaaaccgatcattt

SEQ ID NO: 15842 - DNA, 28 bp, Artificial Sequence
  Primer
aaactcgagtagaagctcctgccacgtc

SEQ ID NO: 15843 - DNA, 29 bp, Artificial Sequence
  Primer
aaactcgagtaggcagcaaagtgacctcc

SEQ ID NO: 15844 - DNA, 31 bp, Artificial Sequence
  Primer
aaactcgagtataggatcatggcttagctgc

SEQ ID NO: 15845 - DNA, 31 bp, Artificial Sequence
  Primer
aaactcgagtccaaattacgtcaacaagtgg

SEQ ID NO: 15846 - DNA, 32 bp, Artificial Sequence
  Primer
aaactcgagtccagaaatgatcgaaataccac

SEQ ID NO: 15847 - DNA, 31 bp, Artificial Sequence
  Primer
aaactcgagtcgaaatcgtcacactttgttg

SEQ ID NO: 15848 - DNA, 31 bp, Artificial Sequence
  Primer
aaactcgagtctcttccattgctttggtttg

SEQ ID NO: 15849 - DNA, 31 bp, Artificial Sequence
  Primer
aaactcgagtgaaccaaatgtcaatgactgc

SEQ ID NO: 15850 - DNA, 33 bp, Artificial Sequence
  Primer
aaactcgagtgaatctaatcccagagaagatgg

SEQ ID NO: 15851 - DNA, 31 bp, Artificial Sequence
  Primer
aaactcgagtgatgcatcgtcagtacactcc

SEQ ID NO: 15852 - DNA, 30 bp, Artificial Sequence
  Primer
aaactcgagtgattaggcagcaaagtgacc

SEQ ID NO: 15853 - DNA, 31 bp, Artificial Sequence
  Primer
aaactcgagtgccaaacgtgtatgattgaac

SEQ ID NO: 15854 - DNA, 31 bp, Artificial Sequence
  Primer
aaactcgagtgctacaaattgaggcaaacac

SEQ ID NO: 15855 - DNA, 31 bp, Artificial Sequence
  Primer
aaactcgagtggtaggcttgagaatcagtcc

SEQ ID NO: 15856 - DNA, 29 bp, Artificial Sequence
  Primer
aaactcgagtgtcagaaaccatggccatc

SEQ ID NO: 15857 - DNA, 35 bp, Artificial Sequence
  Primer
aaactcgagttaagatgaaacgatttaagtcgacg

SEQ ID NO: 15858 - DNA, 36 bp, Artificial Sequence
  Primer
aaactcgagttaagtgcaccatatcatacgctagtt

SEQ ID NO: 15859 - DNA, 31 bp, Artificial Sequence
  Primer
aaactcgagttacaaacaagcaagaccgtcc

SEQ ID NO: 15860 - DNA, 34 bp, Artificial Sequence
  Primer
aaactcgagttagcagtctgattatgtggcaaag

SEQ ID NO: 15861 - DNA, 27 bp, Artificial Sequence
  Primer
aaactcgagttcctctgcaatggcgac

SEQ ID NO: 15862 - DNA, 31 bp, Artificial Sequence
  Primer
aaactcgagttcgatttgatcaccaactctc

SEQ ID NO: 15863 - DNA, 31 bp, Artificial Sequence
  Primer
aaagaattcaaaccaaaccagcaaaccatac

SEQ ID NO: 15864 - DNA, 31 bp, Artificial Sequence
  Primer
aaagaattcaaagcagaggtggacattcatc

SEQ ID NO: 15865 - DNA, 31 bp, Artificial Sequence
  Primer
aaagaattcaacatccgaatcaagcctagtg

SEQ ID NO: 15866 - DNA, 33 bp, Artificial Sequence
  Primer
aaagaattcaacatttctacccaaggttgtctg

SEQ ID NO: 15867 - DNA, 32 bp, Artificial Sequence
  Primer
aaagaattcaactgcaacataaacttgccaac

SEQ ID NO: 15868 - DNA, 31 bp, Artificial Sequence
  Primer
aaagaattcaatcaaactgatccaaggttgc

SEQ ID NO: 15869 - DNA, 34 bp, Artificial Sequence
  Primer
aaagaattcaatgccaacataactaatccttacg

SEQ ID NO: 15870 - DNA, 31 bp, Artificial Sequence
  Primer
aaagaattcaccaagtgtcctcttccctagc

SEQ ID NO: 15871 - DNA, 31 bp, Artificial Sequence
  Primer
aaagaattcaccacaagttctttctccatgc

SEQ ID NO: 15872 - DNA, 31 bp, Artificial Sequence
  Primer
aaagaattcactgcctactcgatcaatctgg

SEQ ID NO: 15873 - DNA, 30 bp, Artificial Sequence
  Primer
aaagaattcagattttcaaatccgtccacc

SEQ ID NO: 15874 - DNA, 31 bp, Artificial Sequence
  Primer
aaagaattcagcaacctgaacaagaaagacg

SEQ ID NO: 15875 - DNA, 31 bp, Artificial Sequence
  Primer
aaagaattcatatcgcgtggtaggtaggttg

SEQ ID NO: 15876 - DNA, 31 bp, Artificial Sequence
  Primer
aaagaattcatttcaatatgcccatgtcctg

SEQ ID NO: 15877 - DNA, 36 bp, Artificial Sequence
  Primer
aaagaattccaaatgctaagctgcatcatttattag

SEQ ID NO: 15878 - DNA, 36 bp, Artificial Sequence
  Primer
aaagaattccaagaaccttgtgaagtagaaaatatg

SEQ ID NO: 15879 - DNA, 34 bp, Artificial Sequence
  Primer
aaagaattccaagagtgatgtgatttcaatatgc

SEQ ID NO: 15880 - DNA, 36 bp, Artificial Sequence
  Primer
aaagaattccaatcatatagcatcggttctatgtcg

SEQ ID NO: 15881 - DNA, 36 bp, Artificial Sequence
  Primer
aaagaattccagcaaaccatacatacagatacaaac

SEQ ID NO: 15882 - DNA, 32 bp, Artificial Sequence
  Primer
aaagaattccatgaacagcaccaactaaatcc

SEQ ID NO: 15883 - DNA, 33 bp, Artificial Sequence
  Primer
aaagaattcccacttatcgaataaacaaccacc

SEQ ID NO: 15884 - DNA, 33 bp, Artificial Sequence
  Primer
aaagaattcccgatccgtaatacagtcagtttg

SEQ ID NO: 15885 - DNA, 30 bp, Artificial Sequence
  Primer
aaagaattccgggctgccaattaatctatc

SEQ ID NO: 15886 - DNA, 35 bp, Artificial Sequence
  Primer
aaagaattcctaaaatgaccaacaagccaagtatg

SEQ ID NO: 15887 - DNA, 35 bp, Artificial Sequence
  Primer
aaagaattcctaacttgcccaactcattgtatctc

SEQ ID NO: 15888 - DNA, 34 bp, Artificial Sequence
  Primer
aaagaattcctaatatgacaccgagacagacttg

SEQ ID NO: 15889 - DNA, 33 bp, Artificial Sequence
  Primer
aaagaattcctacaccgagacagacttgcatac

SEQ ID NO: 15890 - DNA, 34 bp, Artificial Sequence
  Primer
aaagaattcctaccatatcacccttgacaccttc

SEQ ID NO: 15891 - DNA, 31 bp, Artificial Sequence
  Primer
aaagaattcctccctacctaggcgatcaaag

SEQ ID NO: 15892 - DNA, 29 bp, Artificial Sequence
  Primer
aaagaattcctctgccgatcacaatttgg

SEQ ID NO: 15893 - DNA, 31 bp, Artificial Sequence
  Primer
aaagaattcgagaacaacagaccgaggattg

SEQ ID NO: 15894 - DNA, 31 bp, Artificial Sequence
  Primer
aaagaattcgctagtcatgccaatcccttag

SEQ ID NO: 15895 - DNA, 30 bp, Artificial Sequence
  Primer
aaagaattcggccaacggagttatccatac

SEQ ID NO: 15896 - DNA, 31 bp, Artificial Sequence
  Primer
aaagaattcgtaaacctcgcaatcaaagtcc

SEQ ID NO: 15897 - DNA, 31 bp, Artificial Sequence
  Primer
aaagaattcgtatggaaccgaactaccgaag

SEQ ID NO: 15898 - DNA, 30 bp, Artificial Sequence
  Primer
aaagaattcgttcatcaacttgcccaactc

SEQ ID NO: 15899 - DNA, 31 bp, Artificial Sequence
  Primer
aaagaattctatagggaaattgtgcaggtcc

SEQ ID NO: 15900 - DNA, 31 bp, Artificial Sequence
  Primer
aaagaattctatggcctccagtgcattaaac

SEQ ID NO: 15901 - DNA, 35 bp, Artificial Sequence
  Primer
aaagaattctcaaacaacataatcaatcaatcctt

SEQ ID NO: 15902 - DNA, 31 bp, Artificial Sequence
  Primer
aaagaattctcacgtacgagaacaacagacc

SEQ ID NO: 15903 - DNA, 33 bp, Artificial Sequence
  Primer
aaagaattctcagcaggaatagtacaacagtgc

SEQ ID NO: 15904 - DNA, 31 bp, Artificial Sequence
  Primer
aaagaattctctatcatgaactgcccttgtg

SEQ ID NO: 15905 - DNA, 31 bp, Artificial Sequence
  Primer
aaagaattctgccaaatgagctatctgagtg

SEQ ID NO: 15906 - DNA, 32 bp, Artificial Sequence
  Primer
aaagaattctgttgaactctggttacagggag

SEQ ID NO: 15907 - DNA, 32 bp, Artificial Sequence
  Primer
aaagaattctgttgctccactatacttgccac

SEQ ID NO: 15908 - DNA, 31 bp, Artificial Sequence
  Primer
aaagaattcttactgggatgaatggttctgc

SEQ ID NO: 15909 - DNA, 35 bp, Artificial Sequence
  Primer
aaagaattcttatcccagatttttaaccatgtacc

SEQ ID NO: 15910 - DNA, 32 bp, Artificial Sequence
  Primer
aaagaattcttcaaccaaattagctgttccag

SEQ ID NO: 15911 - DNA, 33 bp, Artificial Sequence
  Primer
aaagaattcttcagattacagaaacttggatgc

SEQ ID NO: 15912 - DNA, 31 bp, Artificial Sequence
  Primer
aaagaattcttccaacatcacttgcatcttc

SEQ ID NO: 15913 - DNA, 33 bp, Artificial Sequence
  Primer
aaagagctcctaaatcccaaactcaagctgttg

SEQ ID NO: 15914 - DNA, 32 bp, Artificial Sequence
  Primer
aaagagctcgatggacggatcttacattcttg

SEQ ID NO: 15915 - DNA, 33 bp, Artificial Sequence
  Primer
aaagagctctcttacattcttgggttttcatcc

SEQ ID NO: 15916 - DNA, 32 bp, Artificial Sequence
  Primer
aaagatatcagcattacatcagcacttgaatg

SEQ ID NO: 15917 - DNA, 26 bp, Artificial Sequence
  Primer
aaagatatcatcgccatttcggatcc

SEQ ID NO: 15918 - DNA, 35 bp, Artificial Sequence
  Primer
aaagatatccaactacaagtacaacaacaccttgg

SEQ ID NO: 15919 - DNA, 32 bp, Artificial Sequence
  Primer
aaagatatcctagacattcatgatcccaccag

SEQ ID NO: 15920 - DNA, 31 bp, Artificial Sequence
  Primer
aaagatatcgggcaacaaggctttattagtg

SEQ ID NO: 15921 - DNA, 31 bp, Artificial Sequence
  Primer
aaagatatctgaactactctggacatggtgc

SEQ ID NO: 15922 - DNA, 32 bp, Artificial Sequence
  Primer
aaagatatctggatacaaagaggcaagtgaac

SEQ ID NO: 15923 - DNA, 36 bp, Artificial Sequence
  Primer
aaagatatcttattaggtactgagagcaggttccag

SEQ ID NO: 15924 - DNA, 32 bp, Artificial Sequence
  Primer
aaagatatcttgagaatcaaaggcagagagag

SEQ ID NO: 15925 - DNA, 29 bp, Artificial Sequence
  Primer
aaaggatccaaaacatatggggaaagcac

SEQ ID NO: 15926 - DNA, 33 bp, Artificial Sequence
  Primer
aaaggatccaaacacagacactctcctttctcc

SEQ ID NO: 15927 - DNA, 27 bp, Artificial Sequence
  Primer
aaaggatccaaacaccaccatggcagc

SEQ ID NO: 15928 - DNA, 31 bp, Artificial Sequence
  Primer
aaaggatccaaaccctaagcatggattgaag

SEQ ID NO: 15929 - DNA, 31 bp, Artificial Sequence
  Primer
aaaggatccaaacctatgcgaagctcaaagc

SEQ ID NO: 15930 - DNA, 31 bp, Artificial Sequence
  Primer
aaaggatccaaagcatccatccctaacttcc

SEQ ID NO: 15931 - DNA, 31 bp, Artificial Sequence
  Primer
aaaggatccaaagcgcaacattctccttatc

SEQ ID NO: 15932 - DNA, 31 bp, Artificial Sequence
  Primer
aaaggatccaaatcgtcttaaacggagggag

SEQ ID NO: 15933 - DNA, 31 bp, Artificial Sequence
  Primer
aaaggatccaaatctgatgatgcgtttgagc

SEQ ID NO: 15934 - DNA, 32 bp, Artificial Sequence
  Primer
aaaggatccaacaaatgacgtgaaagttcttc

SEQ ID NO: 15935 - DNA, 30 bp, Artificial Sequence
  Primer
aaaggatccaacaagcccaccaatctcttc

SEQ ID NO: 15936 - DNA, 31 bp, Artificial Sequence
  Primer
aaaggatccaacacaccaacactgcaaattc

SEQ ID NO: 15937 - DNA, 36 bp, Artificial Sequence
  Primer
aaaggatccaacacacttgggtaatagaaatctgtc

SEQ ID NO: 15938 - DNA, 36 bp, Artificial Sequence
  Primer
aaaggatccaacactctttcttgaatcttgaaactc

SEQ ID NO: 15939 - DNA, 32 bp, Artificial Sequence
  Primer
aaaggatccaacatgggatgactgatacatgg

SEQ ID NO: 15940 - DNA, 31 bp, Artificial Sequence
  Primer
aaaggatccaaccctcaatactcaaagcaag

SEQ ID NO: 15941 - DNA, 31 bp, Artificial Sequence
  Primer
aaaggatccaacgtcaccttccaatacaacc

SEQ ID NO: 15942 - DNA, 31 bp, Artificial Sequence
  Primer
aaaggatccaacgtgtaacactggtcgaaag

SEQ ID NO: 15943 - DNA, 31 bp, Artificial Sequence
  Primer
aaaggatccaactcaatccgctgccttattc

SEQ ID NO: 15944 - DNA, 32 bp, Artificial Sequence
  Primer
aaaggatccaagaagatgaagaagcagcagac

SEQ ID NO: 15945 - DNA, 30 bp, Artificial Sequence
  Primer
aaaggatccaagaatcgtggagatggcttc

SEQ ID NO: 15946 - DNA, 31 bp, Artificial Sequence
  Primer
aaaggatccaagatcgagagaattcgcaaac

SEQ ID NO: 15947 - DNA, 31 bp, Artificial Sequence
  Primer
aaaggatccaagccactcaccgatagagaag

SEQ ID NO: 15948 - DNA, 31 bp, Artificial Sequence
  Primer
aaaggatccaagtgggttgacatgtggtagc

SEQ ID NO: 15949 - DNA, 34 bp, Artificial Sequence
  Primer
aaaggatccaatatcgtgttagattcacccactg

SEQ ID NO: 15950 - DNA, 31 bp, Artificial Sequence
  Primer
aaaggatccaatccaatcggaacagtgagag

SEQ ID NO: 15951 - DNA, 35 bp, Artificial Sequence
  Primer
aaaggatccaatgttgaagaaagtgtgagaaaatg

SEQ ID NO: 15952 - DNA, 31 bp, Artificial Sequence
  Primer
aaaggatccaccaaaccaaccatagtccaag

SEQ ID NO: 15953 - DNA, 30 bp, Artificial Sequence
  Primer
aaaggatccacccaaccgcttaaacctctc

SEQ ID NO: 15954 - DNA, 32 bp, Artificial Sequence
  Primer
aaaggatccacccgtgtattaaactcaacgtc

SEQ ID NO: 15955 - DNA, 31 bp, Artificial Sequence
  Primer
aaaggatccacccttctgatccagaattcac

SEQ ID NO: 15956 - DNA, 32 bp, Artificial Sequence
  Primer
aaaggatccacctaattcttgggacctttcag

SEQ ID NO: 15957 - DNA, 31 bp, Artificial Sequence
  Primer
aaaggatccacctcgttggtttctgagacag

SEQ ID NO: 15958 - DNA, 31 bp, Artificial Sequence
  Primer
aaaggatccacgccattgaagctcattctac

SEQ ID NO: 15959 - DNA, 30 bp, Artificial Sequence
  Primer
aaaggatccacgtttgaaacaaacaccacc

SEQ ID NO: 15960 - DNA, 31 bp, Artificial Sequence
  Primer
aaaggatccactaaatcgatggttccctcac

SEQ ID NO: 15961 - DNA, 30 bp, Artificial Sequence
  Primer
aaaggatccactccgtctcaaagggaacag

SEQ ID NO: 15962 - DNA, 33 bp, Artificial Sequence
  Primer
aaaggatccactgcaaattcaactttaacatcg

SEQ ID NO: 15963 - DNA, 28 bp, Artificial Sequence
  Primer
aaaggatccactgctctcgctttcgctc

SEQ ID NO: 15964 - DNA, 34 bp, Artificial Sequence
  Primer
aaaggatccacttggtgaaattgaagaatcaagc

SEQ ID NO: 15965 - DNA, 30 bp, Artificial Sequence
  Primer
aaaggatccagaaaggaaaaccatggctcc

SEQ ID NO: 15966 - DNA, 31 bp, Artificial Sequence
  Primer
aaaggatccagaaagggagaagcgcaaatac

SEQ ID NO: 15967 - DNA, 31 bp, Artificial Sequence
  Primer
aaaggatccagaccctatcccatctcattgg

SEQ ID NO: 15968 - DNA, 31 bp, Artificial Sequence
  Primer
aaaggatccagagaatccccatatcagcacc

SEQ ID NO: 15969 - DNA, 33 bp, Artificial Sequence
  Primer
aaaggatccagagagagaagaagaatcgtggag

SEQ ID NO: 15970 - DNA, 31 bp, Artificial Sequence
  Primer
aaaggatccagagtttcgtctacgcaggaac

SEQ ID NO: 15971 - DNA, 33 bp, Artificial Sequence
  Primer
aaaggatccagattctctaattccgttccttcc

SEQ ID NO: 15972 - DNA, 33 bp, Artificial Sequence
  Primer
aaaggatccagcaacaaggagaggctagaattg

SEQ ID NO: 15973 - DNA, 31 bp, Artificial Sequence
  Primer
aaaggatccagcaagggaaatcaggaaactc

SEQ ID NO: 15974 - DNA, 31 bp, Artificial Sequence
  Primer
aaaggatccagcatagcagcactgaagttcg

SEQ ID NO: 15975 - DNA, 31 bp, Artificial Sequence
  Primer
aaaggatccagccaaaagtgctgcaatagag

SEQ ID NO: 15976 - DNA, 30 bp, Artificial Sequence
  Primer
aaaggatccagcgactttgtgggaagagtc

SEQ ID NO: 15977 - DNA, 31 bp, Artificial Sequence
  Primer
aaaggatccagctctgaacaacgaacacaac

SEQ ID NO: 15978 - DNA, 31 bp, Artificial Sequence
  Primer
aaaggatccagggataattgtgaaggaatcg

SEQ ID NO: 15979 - DNA, 31 bp, Artificial Sequence
  Primer
aaaggatccaggtgggtttctcatcctaagc

SEQ ID NO: 15980 - DNA, 31 bp, Artificial Sequence
  Primer
aaaggatccagtaacgtaaccgtcgttcgtg

SEQ ID NO: 15981 - DNA, 30 bp, Artificial Sequence
  Primer
aaaggatccagtgttgggttgagtgtctcc

SEQ ID NO: 15982 - DNA, 33 bp, Artificial Sequence
  Primer
aaaggatccatatagtgagagtgagagcccgag

SEQ ID NO: 15983 - DNA, 31 bp, Artificial Sequence
  Primer
aaaggatccatattccattgccattaccgac

SEQ ID NO: 15984 - DNA, 33 bp, Artificial Sequence
  Primer
aaaggatccatattgtcccgtgtttcttgtttc

SEQ ID NO: 15985 - DNA, 31 bp, Artificial Sequence
  Primer
aaaggatccatccatcgtcaacagtgaagtg

SEQ ID NO: 15986 - DNA, 30 bp, Artificial Sequence
  Primer
aaaggatccatcccacaggtttgagcctac

SEQ ID NO: 15987 - DNA, 31 bp, Artificial Sequence
  Primer
aaaggatccatcgcagtctttcaaattcgtc

SEQ ID NO: 15988 - DNA, 30 bp, Artificial Sequence
  Primer
aaaggatccatcgtcatcatctcgtccccc

SEQ ID NO: 15989 - DNA, 30 bp, Artificial Sequence
  Primer
aaaggatccatgaagctgagcgactttgtg

SEQ ID NO: 15990 - DNA, 33 bp, Artificial Sequence
  Primer
aaaggatccatgtaatgcatatgcattgtgtgc

SEQ ID NO: 15991 - DNA, 31 bp, Artificial Sequence
  Primer
aaaggatccatgttcctctgcaactctgacc

SEQ ID NO: 15992 - DNA, 31 bp, Artificial Sequence
  Primer
aaaggatccattaatggtgggtggaaatcac

SEQ ID NO: 15993 - DNA, 31 bp, Artificial Sequence
  Primer
aaaggatccattaggtggaagagaaggaagc

SEQ ID NO: 15994 - DNA, 31 bp, Artificial Sequence
  Primer
aaaggatccattattagccctctccgaccac

SEQ ID NO: 15995 - DNA, 35 bp, Artificial Sequence
  Primer
aaaggatccattccataatctctctctttctttgc

SEQ ID NO: 15996 - DNA, 29 bp, Artificial Sequence
  Primer
aaaggatccattcctatggctgctgcttc

SEQ ID NO: 15997 - DNA, 36 bp, Artificial Sequence
  Primer
aaaggatccattctattaggctttcatctcagacag

SEQ ID NO: 15998 - DNA, 28 bp, Artificial Sequence
  Primer
aaaggatccattgaaggtggcgtttgag

SEQ ID NO: 15999 - DNA, 31 bp, Artificial Sequence
  Primer
aaaggatccattgctcccaaacagttgactc

SEQ ID NO: 16000 - DNA, 31 bp, Artificial Sequence
  Primer
aaaggatccatttagcgagtcaaagacgtgg

SEQ ID NO: 16001 - DNA, 31 bp, Artificial Sequence
  Primer
aaaggatccatttcaaccgttgttccatagc

SEQ ID NO: 16002 - DNA, 27 bp, Artificial Sequence
  Primer
aaaggatccatttcaccgctgctcctc

SEQ ID NO: 16003 - DNA, 32 bp, Artificial Sequence
  Primer
aaaggatccatttcacttcattctgctccctc

SEQ ID NO: 16004 - DNA, 29 bp, Artificial Sequence
  Primer
aaaggatccatttccactttcgccaaacc

SEQ ID NO: 16005 - DNA, 29 bp, Artificial Sequence
  Primer
aaaggatcccaagagagatggccatcagc

SEQ ID NO: 16006 - DNA, 31 bp, Artificial Sequence
  Primer
aaaggatcccaatcaccacacgagagaagag

SEQ ID NO: 16007 - DNA, 31 bp, Artificial Sequence
  Primer
aaaggatcccaatctctacatcgcattctcg

SEQ ID NO: 16008 - DNA, 33 bp, Artificial Sequence
  Primer
aaaggatcccaattgcaatggcttctttatttc

SEQ ID NO: 16009 - DNA, 30 bp, Artificial Sequence
  Primer
aaaggatcccacaataggacccagggaatg

SEQ ID NO: 16010 - DNA, 32 bp, Artificial Sequence
  Primer
aaaggatcccacactcattgatccacttctcc

SEQ ID NO: 16011 - DNA, 28 bp, Artificial Sequence
  Primer
aaaggatcccacattccgtttccattcg

SEQ ID NO: 16012 - DNA, 31 bp, Artificial Sequence
  Primer
aaaggatcccaccaacaaaaagaaatttcca

SEQ ID NO: 16013 - DNA, 31 bp, Artificial Sequence
  Primer
aaaggatcccaccacctgcacctctcttaac

SEQ ID NO: 16014 - DNA, 29 bp, Artificial Sequence
  Primer
aaaggatcccacgtaacaccacacccttc

SEQ ID NO: 16015 - DNA, 31 bp, Artificial Sequence
  Primer
aaaggatcccactctgtctttctttgcatgg

SEQ ID NO: 16016 - DNA, 31 bp, Artificial Sequence
  Primer
aaaggatcccactgccactttgatttgattc

SEQ ID NO: 16017 - DNA, 28 bp, Artificial Sequence
  Primer
aaaggatcccactgccttcttccgcttc

SEQ ID NO: 16018 - DNA, 34 bp, Artificial Sequence
  Primer
aaaggatcccactgggttgtgttgtgtttatacc

SEQ ID NO: 16019 - DNA, 33 bp, Artificial Sequence
  Primer
aaaggatcccagaacagagaactgttgaagagg

SEQ ID NO: 16020 - DNA, 31 bp, Artificial Sequence
  Primer
aaaggatcccagccgttaatcatgtgtcaag

SEQ ID NO: 16021 - DNA, 25 bp, Artificial Sequence
  Primer
aaaggatcccaggcttcgctcccca

SEQ ID NO: 16022 - DNA, 31 bp, Artificial Sequence
  Primer
aaaggatcccagtgctcactgtcttaccacc

SEQ ID NO: 16023 - DNA, 31 bp, Artificial Sequence
  Primer
aaaggatcccatagttgctgtgcaaggtttg

SEQ ID NO: 16024 - DNA, 29 bp, Artificial Sequence
  Primer
aaaggatcccatatccggtgatacgcctc

SEQ ID NO: 16025 - DNA, 30 bp, Artificial Sequence
  Primer
aaaggatcccatcatcttcatcgacccaac

SEQ ID NO: 16026 - DNA, 29 bp, Artificial Sequence
  Primer
aaaggatcccatggcatgcaatctgaatc

SEQ ID NO: 16027 - DNA, 31 bp, Artificial Sequence
  Primer
aaaggatcccattgctgtcggattctctacc

SEQ ID NO: 16028 - DNA, 31 bp, Artificial Sequence
  Primer
aaaggatcccattggagtgttgtgactttgc

SEQ ID NO: 16029 - DNA, 31 bp, Artificial Sequence
  Primer
aaaggatccccaaaccatgtgtacaagttcc

SEQ ID NO: 16030 - DNA, 31 bp, Artificial Sequence
  Primer
aaaggatccccaacccatatttcatctcctc

SEQ ID NO: 16031 - DNA, 32 bp, Artificial Sequence
  Primer
aaaggatccccatagcaatagaagtgacggtg

SEQ ID NO: 16032 - DNA, 30 bp, Artificial Sequence
  Primer
aaaggatccccatttggtttctcttccctg

SEQ ID NO: 16033 - DNA, 30 bp, Artificial Sequence
  Primer
aaaggatcccccaaacaataacacgatgtg

SEQ ID NO: 16034 - DNA, 30 bp, Artificial Sequence
  Primer
aaaggatcccccaacaatgcattaagggtc

SEQ ID NO: 16035 - DNA, 31 bp, Artificial Sequence
  Primer
aaaggatcccccttctctgttctcaatttgc

SEQ ID NO: 16036 - DNA, 31 bp, Artificial Sequence
  Primer
aaaggatcccctaaaaacctctccacaatgc

SEQ ID NO: 16037 - DNA, 28 bp, Artificial Sequence
  Primer
aaaggatcccctcactgctctcgctttc

SEQ ID NO: 16038 - DNA, 32 bp, Artificial Sequence
  Primer
aaaggatcccctgaatttgttattgcaactgg

SEQ ID NO: 16039 - DNA, 30 bp, Artificial Sequence
  Primer
aaaggatcccctgtttgtttgcaatggaag

SEQ ID NO: 16040 - DNA, 31 bp, Artificial Sequence
  Primer
aaaggatccccttcaacgaattagcatcctg

SEQ ID NO: 16041 - DNA, 31 bp, Artificial Sequence
  Primer
aaaggatccccttgagtagagctcttggtgc

SEQ ID NO: 16042 - DNA, 34 bp, Artificial Sequence
  Primer
aaaggatcccgaaaatggctactatagaatctgc

SEQ ID NO: 16043 - DNA, 31 bp, Artificial Sequence
  Primer
aaaggatcccgcaatattgttgatgttcctc

SEQ ID NO: 16044 - DNA, 31 bp, Artificial Sequence
  Primer
aaaggatcccgcttcgtcatttcctattctc

SEQ ID NO: 16045 - DNA, 28 bp, Artificial Sequence
  Primer
aaaggatcccgggtgaagaagcatttcc

SEQ ID NO: 16046 - DNA, 31 bp, Artificial Sequence
  Primer
aaaggatcccgtcttcgttcgtcagttagag

SEQ ID NO: 16047 - DNA, 31 bp, Artificial Sequence
  Primer
aaaggatcccgtgttagattcacccactgac

SEQ ID NO: 16048 - DNA, 32 bp, Artificial Sequence
  Primer
aaaggatcccgttcgtcagttagagcttcttc

SEQ ID NO: 16049 - DNA, 31 bp, Artificial Sequence
  Primer
aaaggatccctaaatcactgttgttgcgtgc

SEQ ID NO: 16050 - DNA, 36 bp, Artificial Sequence
  Primer
aaaggatccctaacctccagcagtatttacacaagg

SEQ ID NO: 16051 - DNA, 30 bp, Artificial Sequence
  Primer
aaaggatccctaagtgctgaaccaaccgtg

SEQ ID NO: 16052 - DNA, 35 bp, Artificial Sequence
  Primer
aaaggatccctaccaacctccagcagtatttacac

SEQ ID NO: 16053 - DNA, 31 bp, Artificial Sequence
  Primer
aaaggatccctacgcaaaggttgttggtcac

SEQ ID NO: 16054 - DNA, 31 bp, Artificial Sequence
  Primer
aaaggatccctatgaggcccatattccattg

SEQ ID NO: 16055 - DNA, 31 bp, Artificial Sequence
  Primer
aaaggatccctcaacgtccaaacaacagaag

SEQ ID NO: 16056 - DNA, 31 bp, Artificial Sequence
  Primer
aaaggatccctcacacgcgctaaaccataac

SEQ ID NO: 16057 - DNA, 31 bp, Artificial Sequence
  Primer
aaaggatccctcgcagaaggtgaagaagaag

SEQ ID NO: 16058 - DNA, 26 bp, Artificial Sequence
  Primer
aaaggatccctcggctcacacgccac

SEQ ID NO: 16059 - DNA, 31 bp, Artificial Sequence
  Primer
aaaggatccctctgctaagcatctttgcctc

SEQ ID NO: 16060 - DNA, 31 bp, Artificial Sequence
  Primer
aaaggatccctgactcggttgtttctcactg

SEQ ID NO: 16061 - DNA, 31 bp, Artificial Sequence
  Primer
aaaggatccctgattgatgtgagccaatgtc

SEQ ID NO: 16062 - DNA, 31 bp, Artificial Sequence
  Primer
aaaggatccctggaagaagtttgaaggaacg

SEQ ID NO: 16063 - DNA, 31 bp, Artificial Sequence
  Primer
aaaggatcccttgtgcacgtcagaaacaaac

SEQ ID NO: 16064 - DNA, 31 bp, Artificial Sequence
  Primer
aaaggatccctttagatccggaagttgcttg

SEQ ID NO: 16065 - DNA, 33 bp, Artificial Sequence
  Primer
aaaggatccctttcaactttcacgtaacaccac

SEQ ID NO: 16066 - DNA, 28 bp, Artificial Sequence
  Primer
aaaggatccctttccattccaccgcatc

SEQ ID NO: 16067 - DNA, 29 bp, Artificial Sequence
  Primer
aaaggatccgaaatatagcccacgccacc

SEQ ID NO: 16068 - DNA, 31 bp, Artificial Sequence
  Primer
aaaggatccgaacacaaagttgaggtcctgg

SEQ ID NO: 16069 - DNA, 34 bp, Artificial Sequence
  Primer
aaaggatccgaagaacagaagagaaaggttctgg

SEQ ID NO: 16070 - DNA, 31 bp, Artificial Sequence
  Primer
aaaggatccgaagcatcagacacagttggag

SEQ ID NO: 16071 - DNA, 31 bp, Artificial Sequence
  Primer
aaaggatccgaattggaaagaagcactcaac

SEQ ID NO: 16072 - DNA, 30 bp, Artificial Sequence
  Primer
aaaggatccgaccgacgacactagctagca

SEQ ID NO: 16073 - DNA, 31 bp, Artificial Sequence
  Primer
aaaggatccgactcctcaacccacttgattc

SEQ ID NO: 16074 - DNA, 38 bp, Artificial Sequence
  Primer
aaaggatccgactttgaagctgtttatattcaattaga

SEQ ID NO: 16075 - DNA, 34 bp, Artificial Sequence
  Primer
aaaggatccgagagagagagagagggtgtgtcta

SEQ ID NO: 16076 - DNA, 29 bp, Artificial Sequence
  Primer
aaaggatccgagctgattcctatggctgc

SEQ ID NO: 16077 - DNA, 31 bp, Artificial Sequence
  Primer
aaaggatccgaggaagcagagtgtgtcactg

SEQ ID NO: 16078 - DNA, 33 bp, Artificial Sequence
  Primer
aaaggatccgaggctagaattgctcttgaaatc

SEQ ID NO: 16079 - DNA, 33 bp, Artificial Sequence
  Primer
aaaggatccgatctcagattttgaacatttttg

SEQ ID NO: 16080 - DNA, 30 bp, Artificial Sequence
  Primer
aaaggatccgatctctggctgtcgactctg

SEQ ID NO: 16081 - DNA, 32 bp, Artificial Sequence
  Primer
aaaggatccgcaaagaagctaagataaaaggg

SEQ ID NO: 16082 - DNA, 31 bp, Artificial Sequence
  Primer
aaaggatccgcaaatgtctcaattccacctc

SEQ ID NO: 16083 - DNA, 30 bp, Artificial Sequence
  Primer
aaaggatccgcaacttcacttgctctctcc

SEQ ID NO: 16084 - DNA, 30 bp, Artificial Sequence
  Primer
aaaggatccgcacgtgagtaggtttcttcg

SEQ ID NO: 16085 - DNA, 28 bp, Artificial Sequence
  Primer
aaaggatccgcagcagggatctctaccg

SEQ ID NO: 16086 - DNA, 31 bp, Artificial Sequence
  Primer
aaaggatccgcaggaacattggagtcttctc

SEQ ID NO: 16087 - DNA, 28 bp, Artificial Sequence
  Primer
aaaggatccgcagtccgtctaccgaatg

SEQ ID NO: 16088 - DNA, 31 bp, Artificial Sequence
  Primer
aaaggatccgcatgaagaaacagctcaaatg

SEQ ID NO: 16089 - DNA, 31 bp, Artificial Sequence
  Primer
aaaggatccgctaaatcagcattgcttgctc

SEQ ID NO: 16090 - DNA, 32 bp, Artificial Sequence
  Primer
aaaggatccgctacactgcaaggataaagagg

SEQ ID NO: 16091 - DNA, 31 bp, Artificial Sequence
  Primer
aaaggatccgctagaagaagaagcagccatc

SEQ ID NO: 16092 - DNA, 35 bp, Artificial Sequence
  Primer
aaaggatccgcttcttcttcaactgacatttcttc

SEQ ID NO: 16093 - DNA, 31 bp, Artificial Sequence
  Primer
aaaggatccggataaagaggcagtgggagag

SEQ ID NO: 16094 - DNA, 36 bp, Artificial Sequence
  Primer
aaaggatccgggttgagatatagagtaagcagtgtg

SEQ ID NO: 16095 - DNA, 35 bp, Artificial Sequence
  Primer
aaaggatccggtccttgtttgtttagagtgttgag

SEQ ID NO: 16096 - DNA, 33 bp, Artificial Sequence
  Primer
aaaggatccggtcgaaagaagacgaacataaac

SEQ ID NO: 16097 - DNA, 32 bp, Artificial Sequence
  Primer
aaaggatccggtgaaattgaagaatcaagcac

SEQ ID NO: 16098 - DNA, 33 bp, Artificial Sequence
  Primer
aaaggatccggtggtgtagtttatcagatgacg

SEQ ID NO: 16099 - DNA, 29 bp, Artificial Sequence
  Primer
aaaggatccggttccctcacagtttcagc

SEQ ID NO: 16100 - DNA, 33 bp, Artificial Sequence
  Primer
aaaggatccggtttggagtatgacttcttgcac

SEQ ID NO: 16101 - DNA, 31 bp, Artificial Sequence
  Primer
aaaggatccggtttggtttggtttgaagatg

SEQ ID NO: 16102 - DNA, 31 bp, Artificial Sequence
  Primer
aaaggatccgtcagtcgtcatggaagtctca

SEQ ID NO: 16103 - DNA, 31 bp, Artificial Sequence
  Primer
aaaggatccgtcagtctggttggttctttgc

SEQ ID NO: 16104 - DNA, 33 bp, Artificial Sequence
  Primer
aaaggatccgtccaagccttatcttcattcttc

SEQ ID NO: 16105 - DNA, 30 bp, Artificial Sequence
  Primer
aaaggatccgtcgagggactcagcttcttc

SEQ ID NO: 16106 - DNA, 31 bp, Artificial Sequence
  Primer
aaaggatccgtgataagggagcagcagagag

SEQ ID NO: 16107 - DNA, 31 bp, Artificial Sequence
  Primer
aaaggatccgtggaaatcacacttcatccag

SEQ ID NO: 16108 - DNA, 31 bp, Artificial Sequence
  Primer
aaaggatccgtgttgccatttcacattcaag

SEQ ID NO: 16109 - DNA, 31 bp, Artificial Sequence
  Primer
aaaggatccgttcaacagaggaagaagcgag

SEQ ID NO: 16110 - DNA, 31 bp, Artificial Sequence
  Primer
aaaggatccgttctcagtgtctctcccttcc

SEQ ID NO: 16111 - DNA, 31 bp, Artificial Sequence
  Primer
aaaggatccgtttactcctccgtcgatttcc

SEQ ID NO: 16112 - DNA, 31 bp, Artificial Sequence
  Primer
aaaggatcctaaaaggctctcctcagtgctc

SEQ ID NO: 16113 - DNA, 31 bp, Artificial Sequence
  Primer
aaaggatcctaaatgcttgtggatctagtgg

SEQ ID NO: 16114 - DNA, 34 bp, Artificial Sequence
  Primer
aaaggatcctacccacatttctttcattctatcc

SEQ ID NO: 16115 - DNA, 31 bp, Artificial Sequence
  Primer
aaaggatcctactgggtggacagaacagaac

SEQ ID NO: 16116 - DNA, 30 bp, Artificial Sequence
  Primer
aaaggatcctagcaaattagccaccaacaa

SEQ ID NO: 16117 - DNA, 32 bp, Artificial Sequence
  Primer
aaaggatcctagtgctttcaaagaggttgagc

SEQ ID NO: 16118 - DNA, 34 bp, Artificial Sequence
  Primer
aaaggatcctcactcataatattcaaccatgtcg

SEQ ID NO: 16119 - DNA, 30 bp, Artificial Sequence
  Primer
aaaggatcctcacttgccgtctctttcttc

SEQ ID NO: 16120 - DNA, 35 bp, Artificial Sequence
  Primer
aaaggatcctcagaaggatcaatacataagttgag

SEQ ID NO: 16121 - DNA, 31 bp, Artificial Sequence
  Primer
aaaggatcctcagagaactgcagtgaattgg

SEQ ID NO: 16122 - DNA, 32 bp, Artificial Sequence
  Primer
aaaggatcctcagatgacgtgtgtgtgttaag

SEQ ID NO: 16123 - DNA, 31 bp, Artificial Sequence
  Primer
aaaggatcctcatgatctattcggaaggagc

SEQ ID NO: 16124 - DNA, 30 bp, Artificial Sequence
  Primer
aaaggatcctccaacttcccaaatctcagg

SEQ ID NO: 16125 - DNA, 29 bp, Artificial Sequence
  Primer
aaaggatcctccacaatgcttttgagacc

SEQ ID NO: 16126 - DNA, 34 bp, Artificial Sequence
  Primer
aaaggatcctccagaagcatcttatgtcactttc

SEQ ID NO: 16127 - DNA, 29 bp, Artificial Sequence
  Primer
aaaggatcctcccaatcacattccgtttc

SEQ ID NO: 16128 - DNA, 31 bp, Artificial Sequence
  Primer
aaaggatcctcccgtgtttcttgtttctgag

SEQ ID NO: 16129 - DNA, 31 bp, Artificial Sequence
  Primer
aaaggatcctcctggccttatcttcatgttg

SEQ ID NO: 16130 - DNA, 35 bp, Artificial Sequence
  Primer
aaaggatcctccttcctcactcataatattcaacc

SEQ ID NO: 16131 - DNA, 33 bp, Artificial Sequence
  Primer
aaaggatcctccttcgcatattagtctcattcc

SEQ ID NO: 16132 - DNA, 32 bp, Artificial Sequence
  Primer
aaaggatcctcctttagatccggaagtttctc

SEQ ID NO: 16133 - DNA, 31 bp, Artificial Sequence
  Primer
aaaggatcctcgagtagccctagctctgaac

SEQ ID NO: 16134 - DNA, 31 bp, Artificial Sequence
  Primer
aaaggatcctcgcaaactcgtttcttcattc

SEQ ID NO: 16135 - DNA, 33 bp, Artificial Sequence
  Primer
aaaggatcctcgttacccacatttctttcattc

SEQ ID NO: 16136 - DNA, 31 bp, Artificial Sequence
  Primer
aaaggatcctctaattccgttccttccgtag

SEQ ID NO: 16137 - DNA, 31 bp, Artificial Sequence
  Primer
aaaggatcctctctgttcattcctctgggtg

SEQ ID NO: 16138 - DNA, 33 bp, Artificial Sequence
  Primer
aaaggatcctctgaagatacaggtgggtttctc

SEQ ID NO: 16139 - DNA, 32 bp, Artificial Sequence
  Primer
aaaggatcctcttcaattgtgactcctcaacc

SEQ ID NO: 16140 - DNA, 32 bp, Artificial Sequence
  Primer
aaaggatcctcttcttccctaaacctaccgag

SEQ ID NO: 16141 - DNA, 36 bp, Artificial Sequence
  Primer
aaaggatcctctttatctttacgctaaccacacatc

SEQ ID NO: 16142 - DNA, 33 bp, Artificial Sequence
  Primer
aaaggatcctctttctttacctcatcaaccagc

SEQ ID NO: 16143 - DNA, 31 bp, Artificial Sequence
  Primer
aaaggatcctctttgggagcaagagatatgg

SEQ ID NO: 16144 - DNA, 31 bp, Artificial Sequence
  Primer
aaaggatcctgaaacctcatagccaaaagtg

SEQ ID NO: 16145 - DNA, 36 bp, Artificial Sequence
  Primer
aaaggatcctgaacacaataaattaatccaaacaca

SEQ ID NO: 16146 - DNA, 33 bp, Artificial Sequence
  Primer
aaaggatcctgaacacacagttacagtgacagc

SEQ ID NO: 16147 - DNA, 32 bp, Artificial Sequence
  Primer
aaaggatcctgaacttcttctccttaggcagc

SEQ ID NO: 16148 - DNA, 31 bp, Artificial Sequence
  Primer
aaaggatcctgaaggaatcgcatcacattac

SEQ ID NO: 16149 - DNA, 31 bp, Artificial Sequence
  Primer
aaaggatcctgacagatcaacatcgcactac

SEQ ID NO: 16150 - DNA, 35 bp, Artificial Sequence
  Primer
aaaggatcctgacgtaactaacaggtaggaattgg

SEQ ID NO: 16151 - DNA, 32 bp, Artificial Sequence
  Primer
aaaggatcctgagcaacctctcatcactacac

SEQ ID NO: 16152 - DNA, 31 bp, Artificial Sequence
  Primer
aaaggatcctgagcgttagaaagaaagggag

SEQ ID NO: 16153 - DNA, 31 bp, Artificial Sequence
  Primer
aaaggatcctgaggttactccgtctcaaagg

SEQ ID NO: 16154 - DNA, 31 bp, Artificial Sequence
  Primer
aaaggatcctgattattgaaggtggcgtttg

SEQ ID NO: 16155 - DNA, 31 bp, Artificial Sequence
  Primer
aaaggatcctgcacacagaaactaaggttgg

SEQ ID NO: 16156 - DNA, 31 bp, Artificial Sequence
  Primer
aaaggatcctgcacttgtgaccttgcaatag

SEQ ID NO: 16157 - DNA, 34 bp, Artificial Sequence
  Primer
aaaggatcctgccttttatacactctgcactctc

SEQ ID NO: 16158 - DNA, 31 bp, Artificial Sequence
  Primer
aaaggatcctgctctgtgttcgtttagttgc

SEQ ID NO: 16159 - DNA, 32 bp, Artificial Sequence
  Primer
aaaggatcctggaagcaatttgatgaagtctc

SEQ ID NO: 16160 - DNA, 31 bp, Artificial Sequence
  Primer
aaaggatcctgggacatttgtgtatttgagc

SEQ ID NO: 16161 - DNA, 30 bp, Artificial Sequence
  Primer
aaaggatcctgtgaagcatttggaaacacc

SEQ ID NO: 16162 - DNA, 34 bp, Artificial Sequence
  Primer
aaaggatcctgttatccttatcctgtttgtttgc

SEQ ID NO: 16163 - DNA, 32 bp, Artificial Sequence
  Primer
aaaggatcctgttcgttctcttattgcgtttg

SEQ ID NO: 16164 - DNA, 35 bp, Artificial Sequence
  Primer
aaaggatccttaagggtgtgatttgatttaggaag

SEQ ID NO: 16165 - DNA, 31 bp, Artificial Sequence
  Primer
aaaggatccttactcgcactcacaacctctc

SEQ ID NO: 16166 - DNA, 32 bp, Artificial Sequence
  Primer
aaaggatccttagtgagggaagagaagctgag

SEQ ID NO: 16167 - DNA, 32 bp, Artificial Sequence
  Primer
aaaggatccttagttgccataacgtcaccttc

SEQ ID NO: 16168 - DNA, 32 bp, Artificial Sequence
  Primer
aaaggatccttatctctttgtcaaatgccacc

SEQ ID NO: 16169 - DNA, 34 bp, Artificial Sequence
  Primer
aaaggatccttcaattagaatgtcttcttcacca

SEQ ID NO: 16170 - DNA, 29 bp, Artificial Sequence
  Primer
aaaggatccttcaccctccacgtttcatc

SEQ ID NO: 16171 - DNA, 29 bp, Artificial Sequence
  Primer
aaaggatccttcacttcacttgccgtctc

SEQ ID NO: 16172 - DNA, 31 bp, Artificial Sequence
  Primer
aaaggatccttcattacctctgtgcaaatcg

SEQ ID NO: 16173 - DNA, 28 bp, Artificial Sequence
  Primer
aaaggatccttccgaaacaaatgacgtg

SEQ ID NO: 16174 - DNA, 29 bp, Artificial Sequence
  Primer
aaaggatccttctccgatcgtctttctgc

SEQ ID NO: 16175 - DNA, 33 bp, Artificial Sequence
  Primer
aaaggatccttcttctgttctcagtgtctctcc

SEQ ID NO: 16176 - DNA, 35 bp, Artificial Sequence
  Primer
aaaggatccttgaagaaagtgtgagaaaatggtag

SEQ ID NO: 16177 - DNA, 29 bp, Artificial Sequence
  Primer
aaaggatccttgaaggaataccgctggag

SEQ ID NO: 16178 - DNA, 31 bp, Artificial Sequence
  Primer
aaaggatccttggattcgaaactgttcagac

SEQ ID NO: 16179 - DNA, 30 bp, Artificial Sequence
  Primer
aaaggatccttggtctaagcaaacaccacc

SEQ ID NO: 16180 - DNA, 33 bp, Artificial Sequence
  Primer
aaaggatccttgtcttctggcttctcctatttc

SEQ ID NO: 16181 - DNA, 31 bp, Artificial Sequence
  Primer
aaaggatccttgttggtcgtgttcatgattc

SEQ ID NO: 16182 - DNA, 30 bp, Artificial Sequence
  Primer
aaaggtaccaaacctctgcttgtatgctgc

SEQ ID NO: 16183 - DNA, 35 bp, Artificial Sequence
  Primer
aaaggtaccaaacttgctcatatcatcatcatcac

SEQ ID NO: 16184 - DNA, 31 bp, Artificial Sequence
  Primer
aaaggtaccaaaggacaacacgcctagtagc

SEQ ID NO: 16185 - DNA, 31 bp, Artificial Sequence
  Primer
aaaggtaccaaatcacaattctgagcagtgg

SEQ ID NO: 16186 - DNA, 31 bp, Artificial Sequence
  Primer
aaaggtaccaacaaactcatgctgctgattg

SEQ ID NO: 16187 - DNA, 31 bp, Artificial Sequence
  Primer
aaaggtaccaacaacctcacaatgcatgaac

SEQ ID NO: 16188 - DNA, 32 bp, Artificial Sequence
  Primer
aaaggtaccaacaagcagttcttgatggaaac

SEQ ID NO: 16189 - DNA, 31 bp, Artificial Sequence
  Primer
aaaggtaccaacacggtgtgcttctctatcc

SEQ ID NO: 16190 - DNA, 31 bp, Artificial Sequence
  Primer
aaaggtaccaacgtaaatgaggattcccaag

SEQ ID NO: 16191 - DNA, 31 bp, Artificial Sequence
  Primer
aaaggtaccaactatccaaagaacagcccag

SEQ ID NO: 16192 - DNA, 32 bp, Artificial Sequence
  Primer
aaaggtaccaactatttcatctcttcgcaacg

SEQ ID NO: 16193 - DNA, 31 bp, Artificial Sequence
  Primer
aaaggtaccaactgcagattcaagcaatgag

SEQ ID NO: 16194 - DNA, 31 bp, Artificial Sequence
  Primer
aaaggtaccaacttatacccgcggtaactcc

SEQ ID NO: 16195 - DNA, 31 bp, Artificial Sequence
  Primer
aaaggtaccaagaacatgtgaaatgctgagg

SEQ ID NO: 16196 - DNA, 31 bp, Artificial Sequence
  Primer
aaaggtaccaagagtgtcctacgtttccatc

SEQ ID NO: 16197 - DNA, 31 bp, Artificial Sequence
  Primer
aaaggtaccaagataatctgtttggcgggtc

SEQ ID NO: 16198 - DNA, 31 bp, Artificial Sequence
  Primer
aaaggtaccaaggaagcatcgtcgtaaggag

SEQ ID NO: 16199 - DNA, 30 bp, Artificial Sequence
  Primer
aaaggtaccaagttgcagaacaattgctgg

SEQ ID NO: 16200 - DNA, 31 bp, Artificial Sequence
  Primer
aaaggtaccaatgctgaagtacatcgcacac

SEQ ID NO: 16201 - DNA, 31 bp, Artificial Sequence
  Primer
aaaggtaccaattgcgtcaacaaacattcac

SEQ ID NO: 16202 - DNA, 32 bp, Artificial Sequence
  Primer
aaaggtaccaatttcacggttgaaacaaagac

SEQ ID NO: 16203 - DNA, 33 bp, Artificial Sequence
  Primer
aaaggtaccacaaggttgctaatcatgagactg

SEQ ID NO: 16204 - DNA, 30 bp, Artificial Sequence
  Primer
aaaggtaccacacagaatgcattaccgcac

SEQ ID NO: 16205 - DNA, 31 bp, Artificial Sequence
  Primer
aaaggtaccacacatttcaatacatggctgc

SEQ ID NO: 16206 - DNA, 31 bp, Artificial Sequence
  Primer
aaaggtaccacacgctctctcttaaacctgc

SEQ ID NO: 16207 - DNA, 31 bp, Artificial Sequence
  Primer
aaaggtaccacagatcacaacagtccgtcag

SEQ ID NO: 16208 - DNA, 31 bp, Artificial Sequence
  Primer
aaaggtaccacagtaattcgttggcccttag

SEQ ID NO: 16209 - DNA, 31 bp, Artificial Sequence
  Primer
aaaggtaccacatcaagtgcagttccagaag

SEQ ID NO: 16210 - DNA, 31 bp, Artificial Sequence
  Primer
aaaggtaccacatggctgcttcacagaatag

SEQ ID NO: 16211 - DNA, 31 bp, Artificial Sequence
  Primer
aaaggtaccaccaagcaataggcaatgcagc

SEQ ID NO: 16212 - DNA, 31 bp, Artificial Sequence
  Primer
aaaggtaccaccatcacaatatttgcacgag

SEQ ID NO: 16213 - DNA, 31 bp, Artificial Sequence
  Primer
aaaggtaccacgatacgatgcgatacaactg

SEQ ID NO: 16214 - DNA, 31 bp, Artificial Sequence
  Primer
aaaggtaccacggtatccttgattggatttg

SEQ ID NO: 16215 - DNA, 31 bp, Artificial Sequence
  Primer
aaaggtaccacgtaactacccatcccatctg

SEQ ID NO: 16216 - DNA, 31 bp, Artificial Sequence
  Primer
aaaggtaccactgttaccatgagcttccagc

SEQ ID NO: 16217 - DNA, 34 bp, Artificial Sequence
  Primer
aaaggtaccacttatgttcctaatttcacggttg

SEQ ID NO: 16218 - DNA, 30 bp, Artificial Sequence
  Primer
aaaggtaccacttgctttgtccttcaatgc

SEQ ID NO: 16219 - DNA, 31 bp, Artificial Sequence
  Primer
aaaggtaccagaagccttgaaacagcaaatg

SEQ ID NO: 16220 - DNA, 31 bp, Artificial Sequence
  Primer
aaaggtaccagatggctgagtggttgatagc

SEQ ID NO: 16221 - DNA, 33 bp, Artificial Sequence
  Primer
aaaggtaccagctaagccaaaaaattgtgattc

SEQ ID NO: 16222 - DNA, 30 bp, Artificial Sequence
  Primer
aaaggtaccagtgagcgtgacaacaccaac

SEQ ID NO: 16223 - DNA, 31 bp, Artificial Sequence
  Primer
aaaggtaccataaagttgttcgtcccacacg

SEQ ID NO: 16224 - DNA, 31 bp, Artificial Sequence
  Primer
aaaggtaccatacaccaaggagcacttcgag

SEQ ID NO: 16225 - DNA, 31 bp, Artificial Sequence
  Primer
aaaggtaccatatacaatgcctcgagagacc

SEQ ID NO: 16226 - DNA, 34 bp, Artificial Sequence
  Primer
aaaggtaccatccactatggaaagtcaggtaacg

SEQ ID NO: 16227 - DNA, 31 bp, Artificial Sequence
  Primer
aaaggtaccatcttgataaccatgccgattc

SEQ ID NO: 16228 - DNA, 31 bp, Artificial Sequence
  Primer
aaaggtaccatgagtgctgctatttgcttcc

SEQ ID NO: 16229 - DNA, 31 bp, Artificial Sequence
  Primer
aaaggtaccatgcatgaactgcatgaacaac

SEQ ID NO: 16230 - DNA, 31 bp, Artificial Sequence
  Primer
aaaggtaccatgtgaatgtgcacttgctttg

SEQ ID NO: 16231 - DNA, 31 bp, Artificial Sequence
  Primer
aaaggtaccattactcaggtagcatggcctc

SEQ ID NO: 16232 - DNA, 31 bp, Artificial Sequence
  Primer
aaaggtaccattccgtttcaggtttctcttg

SEQ ID NO: 16233 - DNA, 31 bp, Artificial Sequence
  Primer
aaaggtaccattcgagacatctccatgatcg

SEQ ID NO: 16234 - DNA, 36 bp, Artificial Sequence
  Primer
aaaggtaccattggtgaagtaaagacacagaattca

SEQ ID NO: 16235 - DNA, 31 bp, Artificial Sequence
  Primer
aaaggtaccatttcactgccttcaacaaacc

SEQ ID NO: 16236 - DNA, 31 bp, Artificial Sequence
  Primer
aaaggtaccatttgtgaaagctgcatgagac

SEQ ID NO: 16237 - DNA, 31 bp, Artificial Sequence
  Primer
aaaggtacccaactttcaacctacagcctcc

SEQ ID NO: 16238 - DNA, 30 bp, Artificial Sequence
  Primer
aaaggtacccaagatgcagctgaagaggag

SEQ ID NO: 16239 - DNA, 31 bp, Artificial Sequence
  Primer
aaaggtacccaatcatttacacacccttctg

SEQ ID NO: 16240 - DNA, 31 bp, Artificial Sequence
  Primer
aaaggtacccacaaatggttgttcattgagg

SEQ ID NO: 16241 - DNA, 35 bp, Artificial Sequence
  Primer
aaaggtacccacaacaaacataatcaacaaacgtc

SEQ ID NO: 16242 - DNA, 31 bp, Artificial Sequence
  Primer
aaaggtacccacattccaaagtagtccacac

SEQ ID NO: 16243 - DNA, 33 bp, Artificial Sequence
  Primer
aaaggtacccaccaacacaaacaggaaagtatg

SEQ ID NO: 16244 - DNA, 30 bp, Artificial Sequence
  Primer
aaaggtacccacttgggcatcaactcctac

SEQ ID NO: 16245 - DNA, 31 bp, Artificial Sequence
  Primer
aaaggtacccagacctgcttaacaccattcc

SEQ ID NO: 16246 - DNA, 32 bp, Artificial Sequence
  Primer
aaaggtacccagcagctaagtgtgaagattcc

SEQ ID NO: 16247 - DNA, 31 bp, Artificial Sequence
  Primer
aaaggtacccatcatcagtcgaggtaagttg

SEQ ID NO: 16248 - DNA, 33 bp, Artificial Sequence
  Primer
aaaggtacccatctgcattcacaaatatggttc

SEQ ID NO: 16249 - DNA, 31 bp, Artificial Sequence
  Primer
aaaggtacccatgagccactcgtagacaatg

SEQ ID NO: 16250 - DNA, 29 bp, Artificial Sequence
  Primer
aaaggtaccccatcttgatcaccaccatc

SEQ ID NO: 16251 - DNA, 31 bp, Artificial Sequence
  Primer
aaaggtaccccattaggagttgccaattctg

SEQ ID NO: 16252 - DNA, 31 bp, Artificial Sequence
  Primer
aaaggtacccccaaactcctctcatctcaag

SEQ ID NO: 16253 - DNA, 32 bp, Artificial Sequence
  Primer
aaaggtaccccgctatgcctcttgtttatacc

SEQ ID NO: 16254 - DNA, 31 bp, Artificial Sequence
  Primer
aaaggtacccctctccactgacatgaagaac

SEQ ID NO: 16255 - DNA, 31 bp, Artificial Sequence
  Primer
aaaggtacccctggttacagcctcgtctatc

SEQ ID NO: 16256 - DNA, 31 bp, Artificial Sequence
  Primer
aaaggtacccgaaatcaaataacgtcccatc

SEQ ID NO: 16257 - DNA, 32 bp, Artificial Sequence
  Primer
aaaggtacccgtcacaagtgaccatcttaatc

SEQ ID NO: 16258 - DNA, 33 bp, Artificial Sequence
  Primer
aaaggtaccctaaaatggaagtgcattcacgag

SEQ ID NO: 16259 - DNA, 33 bp, Artificial Sequence
  Primer
aaaggtaccctaaatctcacgattctcgtcacc

SEQ ID NO: 16260 - DNA, 36 bp, Artificial Sequence
  Primer
aaaggtaccctaaccacgaacaaagacaagtaaatg

SEQ ID NO: 16261 - DNA, 35 bp, Artificial Sequence
  Primer
aaaggtaccctaactgtgaacagcttccaaatcac

SEQ ID NO: 16262 - DNA, 34 bp, Artificial Sequence
  Primer
aaaggtaccctaagcaaccagcacaacatctaac

SEQ ID NO: 16263 - DNA, 39 bp, Artificial Sequence
  Primer
aaaggtaccctaaggatagtgactgtacatgattgatgg

SEQ ID NO: 16264 - DNA, 35 bp, Artificial Sequence
  Primer
aaaggtaccctaagtgggaattgatattgttggtg

SEQ ID NO: 16265 - DNA, 34 bp, Artificial Sequence
  Primer
aaaggtaccctaagttaaggagttccgcacattg

SEQ ID NO: 16266 - DNA, 33 bp, Artificial Sequence
  Primer
aaaggtaccctaatcataggctgcaggtgaaac

SEQ ID NO: 16267 - DNA, 39 bp, Artificial Sequence
  Primer
aaaggtaccctacagaccagaatacaacatgaataaagg

SEQ ID NO: 16268 - DNA, 35 bp, Artificial Sequence
  Primer
aaaggtaccctacagatgcatactgcaatacatcg

SEQ ID NO: 16269 - DNA, 35 bp, Artificial Sequence
  Primer
aaaggtaccctaccaggcaattgatctaaatatgg

SEQ ID NO: 16270 - DNA, 35 bp, Artificial Sequence
  Primer
aaaggtaccctactatatttggtccccgaagaagg

SEQ ID NO: 16271 - DNA, 34 bp, Artificial Sequence
  Primer
aaaggtaccctactgagaattgaagctgaaaacg

SEQ ID NO: 16272 - DNA, 36 bp, Artificial Sequence
  Primer
aaaggtaccctagaagctgaaaacgacatattgaaa

SEQ ID NO: 16273 - DNA, 34 bp, Artificial Sequence
  Primer
aaaggtaccctagaatcccataccacgaacaaag

SEQ ID NO: 16274 - DNA, 33 bp, Artificial Sequence
  Primer
aaaggtaccctagacagaagcaggagggatgtc

SEQ ID NO: 16275 - DNA, 38 bp, Artificial Sequence
  Primer
aaaggtaccctagctccttcggtatcgaactattagag

SEQ ID NO: 16276 - DNA, 34 bp, Artificial Sequence
  Primer
aaaggtaccctaggtagatggaatgatccgaacc

SEQ ID NO: 16277 - DNA, 34 bp, Artificial Sequence
  Primer
aaaggtaccctagtccataattgaacgatgtgtg

SEQ ID NO: 16278 - DNA, 33 bp, Artificial Sequence
  Primer
aaaggtaccctagtgacagaatccccatgaaag

SEQ ID NO: 16279 - DNA, 34 bp, Artificial Sequence
  Primer
aaaggtaccctatatgggaatgtcatgaaagctg

SEQ ID NO: 16280 - DNA, 35 bp, Artificial Sequence
  Primer
aaaggtaccctatccagaattcaaatcataggctg

SEQ ID NO: 16281 - DNA, 32 bp, Artificial Sequence
  Primer
aaaggtaccctatcgggtagatggaatgatcc

SEQ ID NO: 16282 - DNA, 35 bp, Artificial Sequence
  Primer
aaaggtaccctatgaataaagcatgatccgcatac

SEQ ID NO: 16283 - DNA, 34 bp, Artificial Sequence
  Primer
aaaggtaccctattcagctttgccagttaaggag

SEQ ID NO: 16284 - DNA, 34 bp, Artificial Sequence
  Primer
aaaggtaccctattgagagatttgaccatgatgc

SEQ ID NO: 16285 - DNA, 34 bp, Artificial Sequence
  Primer
aaaggtaccctatttgtacagaaaaggaggtgtg

SEQ ID NO: 16286 - DNA, 31 bp, Artificial Sequence
  Primer
aaaggtaccctcctgtgcatcgtgtctattg

SEQ ID NO: 16287 - DNA, 31 bp, Artificial Sequence
  Primer
aaaggtaccctctcacacaacataaccatcg

SEQ ID NO: 16288 - DNA, 30 bp, Artificial Sequence
  Primer
aaaggtaccctcttctctgccacgacaaac

SEQ ID NO: 16289 - DNA, 31 bp, Artificial Sequence
  Primer
aaaggtaccctgatggccacatttactgatg

SEQ ID NO: 16290 - DNA, 31 bp, Artificial Sequence
  Primer
aaaggtacccttggtttgccgttagagaaac

SEQ ID NO: 16291 - DNA, 31 bp, Artificial Sequence
  Primer
aaaggtaccctttctccgtcttgcgtctaac

SEQ ID NO: 16292 - DNA, 31 bp, Artificial Sequence
  Primer
aaaggtaccgaaacgcatatgtcatggactg

SEQ ID NO: 16293 - DNA, 30 bp, Artificial Sequence
  Primer
aaaggtaccgaaagagcagcaagaacctcc

SEQ ID NO: 16294 - DNA, 31 bp, Artificial Sequence
  Primer
aaaggtaccgaaattgaattgcagaagggac

SEQ ID NO: 16295 - DNA, 34 bp, Artificial Sequence
  Primer
aaaggtaccgaactctaatttcctgccaaaattc

SEQ ID NO: 16296 - DNA, 31 bp, Artificial Sequence
  Primer
aaaggtaccgaactgctccaaagtaaggcag

SEQ ID NO: 16297 - DNA, 30 bp, Artificial Sequence
  Primer
aaaggtaccgaagagggagaagcaatgacc

SEQ ID NO: 16298 - DNA, 32 bp, Artificial Sequence
  Primer
aaaggtaccgaagtcagaaacaccttcacagc

SEQ ID NO: 16299 - DNA, 30 bp, Artificial Sequence
  Primer
aaaggtaccgaatctttttatgctgtgccg

SEQ ID NO: 16300 - DNA, 31 bp, Artificial Sequence
  Primer
aaaggtaccgagatcatcacaacgaagtcca

SEQ ID NO: 16301 - DNA, 35 bp, Artificial Sequence
  Primer
aaaggtaccgagccaatacatgttcttaacacaac

SEQ ID NO: 16302 - DNA, 34 bp, Artificial Sequence
  Primer
aaaggtaccgaggaaatcatacaaatcttcaagc

SEQ ID NO: 16303 - DNA, 31 bp, Artificial Sequence
  Primer
aaaggtaccgatttgaacatttcccagcatc

SEQ ID NO: 16304 - DNA, 31 bp, Artificial Sequence
  Primer
aaaggtaccgcaaacaaatttggatcattgg

SEQ ID NO: 16305 - DNA, 32 bp, Artificial Sequence
  Primer
aaaggtaccgcaattaccggtgaatataatgc

SEQ ID NO: 16306 - DNA, 31 bp, Artificial Sequence
  Primer
aaaggtaccgcacaatagcaagaactgctcc

SEQ ID NO: 16307 - DNA, 32 bp, Artificial Sequence
  Primer
aaaggtaccgcagactcagcacatagtaaacg

SEQ ID NO: 16308 - DNA, 33 bp, Artificial Sequence
  Primer
aaaggtaccgcataacacattccaaagtagtcc

SEQ ID NO: 16309 - DNA, 31 bp, Artificial Sequence
  Primer
aaaggtaccgcgagcttcatgtcttctcttc

SEQ ID NO: 16310 - DNA, 36 bp, Artificial Sequence
  Primer
aaaggtaccgctattacaaacttgcaatgaattctc

SEQ ID NO: 16311 - DNA, 31 bp, Artificial Sequence
  Primer
aaaggtaccgctcaacctctacgctacaagc

SEQ ID NO: 16312 - DNA, 30 bp, Artificial Sequence
  Primer
aaaggtaccgctgattgaacagggcatatc

SEQ ID NO: 16313 - DNA, 31 bp, Artificial Sequence
  Primer
aaaggtaccgcttcaacatccttccaagttc

SEQ ID NO: 16314 - DNA, 31 bp, Artificial Sequence
  Primer
aaaggtaccggaatttggaagacaaagcctc

SEQ ID NO: 16315 - DNA, 30 bp, Artificial Sequence
  Primer
aaaggtaccggacttcgagttgattcatgc

SEQ ID NO: 16316 - DNA, 31 bp, Artificial Sequence
  Primer
aaaggtaccggcagactagacattccaaagg

SEQ ID NO: 16317 - DNA, 30 bp, Artificial Sequence
  Primer
aaaggtaccggccaattgattcagtggtag

SEQ ID NO: 16318 - DNA, 31 bp, Artificial Sequence
  Primer
aaaggtaccgtaatgaggcctctgattcaac

SEQ ID NO: 16319 - DNA, 30 bp, Artificial Sequence
  Primer
aaaggtaccgtacatgaacagcggtgatgg

SEQ ID NO: 16320 - DNA, 36 bp, Artificial Sequence
  Primer
aaaggtaccgtcaataagacctaaactatgccaagg

SEQ ID NO: 16321 - DNA, 31 bp, Artificial Sequence
  Primer
aaaggtaccgtcccagtttctgaaatgaagc

SEQ ID NO: 16322 - DNA, 30 bp, Artificial Sequence
  Primer
aaaggtaccgtgatgggcctagctgatcta

SEQ ID NO: 16323 - DNA, 31 bp, Artificial Sequence
  Primer
aaaggtaccgttgaacaagaaaggtgtgtgc

SEQ ID NO: 16324 - DNA, 34 bp, Artificial Sequence
  Primer
aaaggtacctaaatgaaatcaacaacacgaactc

SEQ ID NO: 16325 - DNA, 31 bp, Artificial Sequence
  Primer
aaaggtacctaactaaacggtcccgactcag

SEQ ID NO: 16326 - DNA, 31 bp, Artificial Sequence
  Primer
aaaggtacctacaagccttaactccagcacc

SEQ ID NO: 16327 - DNA, 30 bp, Artificial Sequence
  Primer
aaaggtacctaccttgtggctacttgctgc

SEQ ID NO: 16328 - DNA, 32 bp, Artificial Sequence
  Primer
aaaggtacctagctgataactggattacggtg

SEQ ID NO: 16329 - DNA, 31 bp, Artificial Sequence
  Primer
aaaggtacctagtgccgcacatacatcaaag

SEQ ID NO: 16330 - DNA, 31 bp, Artificial Sequence
  Primer
aaaggtacctatatcctctgcatttgcctct

SEQ ID NO: 16331 - DNA, 31 bp, Artificial Sequence
  Primer
aaaggtacctcagatactttgcatgggagac

SEQ ID NO: 16332 - DNA, 32 bp, Artificial Sequence
  Primer
aaaggtacctcatactgcaagaaaccaaatcc

SEQ ID NO: 16333 - DNA, 30 bp, Artificial Sequence
  Primer
aaaggtacctccaagcactagcaaacaagg

SEQ ID NO: 16334 - DNA, 31 bp, Artificial Sequence
  Primer
aaaggtacctccctttgattacacggttcac

SEQ ID NO: 16335 - DNA, 31 bp, Artificial Sequence
  Primer
aaaggtacctcgatccataataaccaccgtc

SEQ ID NO: 16336 - DNA, 31 bp, Artificial Sequence
  Primer
aaaggtacctcggctaacctgattctagctg

SEQ ID NO: 16337 - DNA, 32 bp, Artificial Sequence
  Primer
aaaggtacctctaattggcattaataggctgg

SEQ ID NO: 16338 - DNA, 31 bp, Artificial Sequence
  Primer
aaaggtacctctcagcgcaattaaccaattc

SEQ ID NO: 16339 - DNA, 32 bp, Artificial Sequence
  Primer
aaaggtacctctcatacacaaggcagactcag

SEQ ID NO: 16340 - DNA, 31 bp, Artificial Sequence
  Primer
aaaggtacctctcctttgcaacttggacttc

SEQ ID NO: 16341 - DNA, 31 bp, Artificial Sequence
  Primer
aaaggtacctgaagctttggtaaccagcaac

SEQ ID NO: 16342 - DNA, 31 bp, Artificial Sequence
  Primer
aaaggtacctgaatacaagttcgaggccaac

SEQ ID NO: 16343 - DNA, 32 bp, Artificial Sequence
  Primer
aaaggtacctgactaaatgtaatgcctcctgc

SEQ ID NO: 16344 - DNA, 35 bp, Artificial Sequence
  Primer
aaaggtacctgattacataattctcttcagccttg

SEQ ID NO: 16345 - DNA, 31 bp, Artificial Sequence
  Primer
aaaggtacctgcacaccactctcagaaagac

SEQ ID NO: 16346 - DNA, 31 bp, Artificial Sequence
  Primer
aaaggtacctgcacagagactaccacgtttc

SEQ ID NO: 16347 - DNA, 32 bp, Artificial Sequence
  Primer
aaaggtacctgcataacacatgaaacccatac

SEQ ID NO: 16348 - DNA, 31 bp, Artificial Sequence
  Primer
aaaggtacctgctaggttccgtatgaagagg

SEQ ID NO: 16349 - DNA, 32 bp, Artificial Sequence
  Primer
aaaggtacctggatgtttccaacttagtttcc

SEQ ID NO: 16350 - DNA, 31 bp, Artificial Sequence
  Primer
aaaggtacctggcatcaatgtttcatgtttc

SEQ ID NO: 16351 - DNA, 31 bp, Artificial Sequence
  Primer
aaaggtacctggcttaaattatcggaagcag

SEQ ID NO: 16352 - DNA, 31 bp, Artificial Sequence
  Primer
aaaggtacctggtgatcccgaatacaaagac

SEQ ID NO: 16353 - DNA, 31 bp, Artificial Sequence
  Primer
aaaggtacctgtgcatcgtgtctattgttcc

SEQ ID NO: 16354 - DNA, 31 bp, Artificial Sequence
  Primer
aaaggtacctgttcgtgaaggtcatatttgc

SEQ ID NO: 16355 - DNA, 31 bp, Artificial Sequence
  Primer
aaaggtacctgttgcctcaatattctgaacc

SEQ ID NO: 16356 - DNA, 32 bp, Artificial Sequence
  Primer
aaaggtaccttaaacttccattccttgcacac

SEQ ID NO: 16357 - DNA, 31 bp, Artificial Sequence
  Primer
aaaggtaccttaacgaatctgcttcatctgc

SEQ ID NO: 16358 - DNA, 33 bp, Artificial Sequence
  Primer
aaaggtaccttacttacagcgtcaagttcatcc

SEQ ID NO: 16359 - DNA, 33 bp, Artificial Sequence
  Primer
aaaggtaccttatccaaaaatagccccttcttc

SEQ ID NO: 16360 - DNA, 33 bp, Artificial Sequence
  Primer
aaaggtaccttattctcctcaccatccaacaag

SEQ ID NO: 16361 - DNA, 33 bp, Artificial Sequence
  Primer
aaaggtaccttattttcacttttgaggactggt

SEQ ID NO: 16362 - DNA, 32 bp, Artificial Sequence
  Primer
aaaggtaccttcaattgagctacaggttctgc

SEQ ID NO: 16363 - DNA, 31 bp, Artificial Sequence
  Primer
aaaggtaccttcagagaagtggagaaccacc

SEQ ID NO: 16364 - DNA, 31 bp, Artificial Sequence
  Primer
aaaggtaccttctacccgtcccttactgaac

SEQ ID NO: 16365 - DNA, 31 bp, Artificial Sequence
  Primer
aaaggtaccttcttccctttaccagctcttg

SEQ ID NO: 16366 - DNA, 34 bp, Artificial Sequence
  Primer
aaaggtaccttgacagaaacaagagtttgaattg

SEQ ID NO: 16367 - DNA, 31 bp, Artificial Sequence
  Primer
aaaggtaccttgcggaataaacgagaatcac

SEQ ID NO: 16368 - DNA, 31 bp, Artificial Sequence
  Primer
aaaggtaccttgctatatttggtccccgaag

SEQ ID NO: 16369 - DNA, 31 bp, Artificial Sequence
  Primer
aaaggtaccttggaagtgggaaatagcaatc

SEQ ID NO: 16370 - DNA, 27 bp, Artificial Sequence
  Primer
aaaggtaccttgtgcagttgcccagac

SEQ ID NO: 16371 - DNA, 35 bp, Artificial Sequence
  Primer
aaagtcgacaaacaatggaagtatctcaggtactg

SEQ ID NO: 16372 - DNA, 30 bp, Artificial Sequence
  Primer
aaagtcgacaaatttgattccgcagtcgtc

SEQ ID NO: 16373 - DNA, 33 bp, Artificial Sequence
  Primer
aaagtcgacaacctttgaatgtgagcaaatagg

SEQ ID NO: 16374 - DNA, 26 bp, Artificial Sequence
  Primer
aaagtcgacaagctagccgcagtgat

SEQ ID NO: 16375 - DNA, 32 bp, Artificial Sequence
  Primer
aaagtcgacaagcttctagaaacaccctctcc

SEQ ID NO: 16376 - DNA, 31 bp, Artificial Sequence
  Primer
aaagtcgacaagcttgctttaggattggagg

SEQ ID NO: 16377 - DNA, 30 bp, Artificial Sequence
  Primer
aaagtcgacaaggaacgcatcagctctctc

SEQ ID NO: 16378 - DNA, 31 bp, Artificial Sequence
  Primer
aaagtcgacaagggaaatacgaatcacaagc

SEQ ID NO: 16379 - DNA, 28 bp, Artificial Sequence
  Primer
aaagtcgacaatcgaagcaccgaaccag

SEQ ID NO: 16380 - DNA, 30 bp, Artificial Sequence
  Primer
aaagtcgacacacgtgcctcattctgattc

SEQ ID NO: 16381 - DNA, 31 bp, Artificial Sequence
  Primer
aaagtcgacacgttgagcgttctctctcttc

SEQ ID NO: 16382 - DNA, 31 bp, Artificial Sequence
  Primer
aaagtcgacacttggaatcagaagaggcttg

SEQ ID NO: 16383 - DNA, 29 bp, Artificial Sequence
  Primer
aaagtcgacaggcctacgtgctggtgtag

SEQ ID NO: 16384 - DNA, 31 bp, Artificial Sequence
  Primer
aaagtcgacagttctatatcccggccatctc

SEQ ID NO: 16385 - DNA, 31 bp, Artificial Sequence
  Primer
aaagtcgacatacctctcattccatccatcg

SEQ ID NO: 16386 - DNA, 31 bp, Artificial Sequence
  Primer
aaagtcgacattaaggcacaatcaccgctac

SEQ ID NO: 16387 - DNA, 31 bp, Artificial Sequence
  Primer
aaagtcgacatttaagactgcagcaacggac

SEQ ID NO: 16388 - DNA, 31 bp, Artificial Sequence
  Primer
aaagtcgaccaaaccatattgggcttcaaaa

SEQ ID NO: 16389 - DNA, 33 bp, Artificial Sequence
  Primer
aaagtcgaccaaactacctgcttctagctctcc

SEQ ID NO: 16390 - DNA, 29 bp, Artificial Sequence
  Primer
aaagtcgaccactttgtcagtttgccgtc

SEQ ID NO: 16391 - DNA, 31 bp, Artificial Sequence
  Primer
aaagtcgaccagcaagggaaatacgaatcac

SEQ ID NO: 16392 - DNA, 36 bp, Artificial Sequence
  Primer
aaagtcgaccataattaaggagaatatctcaaatcg

SEQ ID NO: 16393 - DNA, 32 bp, Artificial Sequence
  Primer
aaagtcgaccatcagctctctcacattctcag

SEQ ID NO: 16394 - DNA, 31 bp, Artificial Sequence
  Primer
aaagtcgaccatgagttgcagctgataaagc

SEQ ID NO: 16395 - DNA, 35 bp, Artificial Sequence
  Primer
aaagtcgaccccaagtatttcttgaagtttacagc

SEQ ID NO: 16396 - DNA, 35 bp, Artificial Sequence
  Primer
aaagtcgaccccaattaatctttgttttcaattcc

SEQ ID NO: 16397 - DNA, 33 bp, Artificial Sequence
  Primer
aaagtcgacccgctgttaaatacctccataaac

SEQ ID NO: 16398 - DNA, 31 bp, Artificial Sequence
  Primer
aaagtcgaccctaatctcctctgagtccagc

SEQ ID NO: 16399 - DNA, 31 bp, Artificial Sequence
  Primer
aaagtcgacccttccctaagcccatgtaatc

SEQ ID NO: 16400 - DNA, 31 bp, Artificial Sequence
  Primer
aaagtcgacccttggtgggtgtttctttagg

SEQ ID NO: 16401 - DNA, 32 bp, Artificial Sequence
  Primer
aaagtcgaccgaatccctaattacaattgctg

SEQ ID NO: 16402 - DNA, 31 bp, Artificial Sequence
  Primer
aaagtcgaccggagaagaagctgtatgatgg

SEQ ID NO: 16403 - DNA, 27 bp, Artificial Sequence
  Primer
aaagtcgaccggagtggtaggagcgac

SEQ ID NO: 16404 - DNA, 30 bp, Artificial Sequence
  Primer
aaagtcgaccgtcggcagaagaagtaactc

SEQ ID NO: 16405 - DNA, 31 bp, Artificial Sequence
  Primer
aaagtcgacctagcatttgttggtggtgttg

SEQ ID NO: 16406 - DNA, 31 bp, Artificial Sequence
  Primer
aaagtcgacctcactctgttggctaagctgc

SEQ ID NO: 16407 - DNA, 32 bp, Artificial Sequence
  Primer
aaagtcgacctctcgtaatcaatcaaaaaccc

SEQ ID NO: 16408 - DNA, 31 bp, Artificial Sequence
  Primer
aaagtcgacctctctcgtggttgtctttcac

SEQ ID NO: 16409 - DNA, 28 bp, Artificial Sequence
  Primer
aaagtcgacctcttggtgtgatccatgg

SEQ ID NO: 16410 - DNA, 29 bp, Artificial Sequence
  Primer
aaagtcgacctgtctccaatggcgttcac

SEQ ID NO: 16411 - DNA, 31 bp, Artificial Sequence
  Primer
aaagtcgaccttagcttggaagcaccttagc

SEQ ID NO: 16412 - DNA, 31 bp, Artificial Sequence
  Primer
aaagtcgaccttcaaaatgatgcagtgagga

SEQ ID NO: 16413 - DNA, 36 bp, Artificial Sequence
  Primer
aaagtcgaccttctgtaaagacaccacctattcttg

SEQ ID NO: 16414 - DNA, 31 bp, Artificial Sequence
  Primer
aaagtcgacgaaacatttcgcttccacactc

SEQ ID NO: 16415 - DNA, 33 bp, Artificial Sequence
  Primer
aaagtcgacgaatcttgaaactttgtgttgtgg

SEQ ID NO: 16416 - DNA, 31 bp, Artificial Sequence
  Primer
aaagtcgacgagtgactctctttcccgcttc

SEQ ID NO: 16417 - DNA, 30 bp, Artificial Sequence
  Primer
aaagtcgacgatacaatggtggaggaagct

SEQ ID NO: 16418 - DNA, 31 bp, Artificial Sequence
  Primer
aaagtcgacgattcgataatgacaccaatgc

SEQ ID NO: 16419 - DNA, 33 bp, Artificial Sequence
  Primer
aaagtcgacgattgttgagagagtgcaattgag

SEQ ID NO: 16420 - DNA, 32 bp, Artificial Sequence
  Primer
aaagtcgacgcaagggctagttagtgatttgg

SEQ ID NO: 16421 - DNA, 31 bp, Artificial Sequence
  Primer
aaagtcgacgcacaaccattcatgtatttgg

SEQ ID NO: 16422 - DNA, 31 bp, Artificial Sequence
  Primer
aaagtcgacgcagaccatggatgacttgttt

SEQ ID NO: 16423 - DNA, 27 bp, Artificial Sequence
  Primer
aaagtcgacgcagcgccttcttccttc

SEQ ID NO: 16424 - DNA, 29 bp, Artificial Sequence
  Primer
aaagtcgacgcgtctctttaggctcctcc

SEQ ID NO: 16425 - DNA, 33 bp, Artificial Sequence
  Primer
aaagtcgacgctctatttaagactgcagcaacg

SEQ ID NO: 16426 - DNA, 31 bp, Artificial Sequence
  Primer
aaagtcgacgctgaggatcaaacagattgtg

SEQ ID NO: 16427 - DNA, 26 bp, Artificial Sequence
  Primer
aaagtcgacgctgctatggcggtctc

SEQ ID NO: 16428 - DNA, 32 bp, Artificial Sequence
  Primer
aaagtcgacgcttcttcaaccccaagtatttc

SEQ ID NO: 16429 - DNA, 32 bp, Artificial Sequence
  Primer
aaagtcgacggattacttgtgcacacacagac

SEQ ID NO: 16430 - DNA, 31 bp, Artificial Sequence
  Primer
aaagtcgacggcttggtagatacaggtctgg

SEQ ID NO: 16431 - DNA, 31 bp, Artificial Sequence
  Primer
aaagtcgacgggaaataacaggcttagcagc

SEQ ID NO: 16432 - DNA, 31 bp, Artificial Sequence
  Primer
aaagtcgacggtaggtggagttcaattcctg

SEQ ID NO: 16433 - DNA, 29 bp, Artificial Sequence
  Primer
aaagtcgacggttaggttacgctggatgc

SEQ ID NO: 16434 - DNA, 31 bp, Artificial Sequence
  Primer
aaagtcgacggttcatttatctttcgcctcc

SEQ ID NO: 16435 - DNA, 29 bp, Artificial Sequence
  Primer
aaagtcgacgtcctcgtttctcctcgaac

SEQ ID NO: 16436 - DNA, 31 bp, Artificial Sequence
  Primer
aaagtcgacgtgtaaaccctgcttctccctc

SEQ ID NO: 16437 - DNA, 31 bp, Artificial Sequence
  Primer
aaagtcgacgttcagctcaatctgggatacg

SEQ ID NO: 16438 - DNA, 29 bp, Artificial Sequence
  Primer
aaagtcgacgttggtttccttgatggcag

SEQ ID NO: 16439 - DNA, 31 bp, Artificial Sequence
  Primer
aaagtcgacgtttggcatcttcttctcatgg

SEQ ID NO: 16440 - DNA, 31 bp, Artificial Sequence
  Primer
aaagtcgactagttggagaaacaacagcagc

SEQ ID NO: 16441 - DNA, 27 bp, Artificial Sequence
  Primer
aaagtcgactcaacttcctcggcaagc

SEQ ID NO: 16442 - DNA, 29 bp, Artificial Sequence
  Primer
aaagtcgactcacaaaacaacatggctgc

SEQ ID NO: 16443 - DNA, 31 bp, Artificial Sequence
  Primer
aaagtcgactccacccacttccagtagtttc

SEQ ID NO: 16444 - DNA, 33 bp, Artificial Sequence
  Primer
aaagtcgactcccaaccctttaatagatacacc

SEQ ID NO: 16445 - DNA, 34 bp, Artificial Sequence
  Primer
aaagtcgactcccacaccctatataaacattcag

SEQ ID NO: 16446 - DNA, 31 bp, Artificial Sequence
  Primer
aaagtcgactcgaaattgaaatccaagtgtg

SEQ ID NO: 16447 - DNA, 31 bp, Artificial Sequence
  Primer
aaagtcgactctcatgttcggtctttgaagc

SEQ ID NO: 16448 - DNA, 36 bp, Artificial Sequence
  Primer
aaagtcgactctctctctcctcattttctatcaaag

SEQ ID NO: 16449 - DNA, 32 bp, Artificial Sequence
  Primer
aaagtcgactctgttctggttaggttacgctg

SEQ ID NO: 16450 - DNA, 31 bp, Artificial Sequence
  Primer
aaagtcgactgggcctagtgacatacctagc

SEQ ID NO: 16451 - DNA, 31 bp, Artificial Sequence
  Primer
aaagtcgactgggtgtaacatttccttcctc

SEQ ID NO: 16452 - DNA, 32 bp, Artificial Sequence
  Primer
aaagtcgactggtagatacaggtctgggattg

SEQ ID NO: 16453 - DNA, 33 bp, Artificial Sequence
  Primer
aaagtcgactgtaaagacaccacctattcttgg

SEQ ID NO: 16454 - DNA, 30 bp, Artificial Sequence
  Primer
aaagtcgactgtgtgcttcgcttcaacttc

SEQ ID NO: 16455 - DNA, 36 bp, Artificial Sequence
  Primer
aaagtcgacttatcgctttgtctttgattttatttg

SEQ ID NO: 16456 - DNA, 33 bp, Artificial Sequence
  Primer
aaagtcgacttcattactctgtttcgccataag

SEQ ID NO: 16457 - DNA, 31 bp, Artificial Sequence
  Primer
aaagtcgacttccgctctatgcactaaaacc

SEQ ID NO: 16458 - DNA, 26 bp, Artificial Sequence
  Primer
aaagtcgacttgcgcggagcttcttc

SEQ ID NO: 16459 - DNA, 29 bp, Artificial Sequence
  Primer
aaagtcgacttgggtgcttacaaggcttc

SEQ ID NO: 16460 - DNA, 24 bp, Artificial Sequence
  Primer
caaaacatttggagtgaacacttg

SEQ ID NO: 16461 - DNA, 24 bp, Artificial Sequence
  Primer
ggaagtaaggtgaagaaaatgtgg

SEQ ID NO: 16462 - DNA, 23 bp, Artificial Sequence
  Primer
ggtttgacattgttgttttgagc

SEQ ID NO: 16463 - DNA, 36 bp, Artificial Sequence
  Primer
tttaggccttcatttaagccagtctttatgacaagc

SEQ ID NO: 16464 - DNA, 30 bp, Artificial Sequence
  Primer
tttaggccttgggtggtcataacttcatca

SEQ ID NO: 16465 - DNA, 38 bp, Artificial Sequence
  Primer
tttaggcctttacctttacttatattcgccagaacttc

SEQ ID NO: 16466 - DNA, 28 bp, Artificial Sequence
  Primer
tttcccgggttggttgcagcactggttc

SEQ ID NO: 16467 - DNA, 34 bp, Artificial Sequence
  Primer
tttctcgagaacatctgtgaagcactaaaacaac

SEQ ID NO: 16468 - DNA, 30 bp, Artificial Sequence
  Primer
tttctcgagaactccggtggctaccctaac

SEQ ID NO: 16469 - DNA, 34 bp, Artificial Sequence
  Primer
tttctcgagatttcttggttcatcagtttgtgct

SEQ ID NO: 16470 - DNA, 30 bp, Artificial Sequence
  Primer
tttctcgagccgtttctgtgaaactcaagc

SEQ ID NO: 16471 - DNA, 31 bp, Artificial Sequence
  Primer
tttctcgaggtcacaggatgatctccagctg

SEQ ID NO: 16472 - DNA, 32 bp, Artificial Sequence
  Primer
tttctcgagtcacttctctacaccccagcagc

SEQ ID NO: 16473 - DNA, 26 bp, Artificial Sequence
  Primer
tttctcgagttatgggcagcatcacg

SEQ ID NO: 16474 - DNA, 36 bp, Artificial Sequence
  Primer
tttctcgagtttaaccatcagtctctatatgctcac

SEQ ID NO: 16475 - DNA, 37 bp, Artificial Sequence
  Primer
tttgaattcttactaaggatcatgatcaataggagca

SEQ ID NO: 16476 - DNA, 30 bp, Artificial Sequence
  Primer
tttgatatccaaccctactgcctcacttcc

SEQ ID NO: 16477 - DNA, 33 bp, Artificial Sequence
  Primer
tttggatccggcagaacatcatacagtatgtgc

SEQ ID NO: 16478 - DNA, 29 bp, Artificial Sequence
  Primer
tttggatccttaatttcacagcctctgcg

SEQ ID NO: 16479 - DNA, 34 bp, Artificial Sequence
  Primer
tttggatccttacaagccagtttgcagaagtaac

SEQ ID NO: 16480 - DNA, 32 bp, Artificial Sequence
  Primer
tttggatccttttcatggagcttattcccact

SEQ ID NO: 16481 - DNA, 29 bp, Artificial Sequence
  Primer
tttggtacccagacttgtactgcgatgcg

SEQ ID NO: 16482 - DNA, 32 bp, Artificial Sequence
  Primer
tttggtaccctagcccttccctactcccaatc

SEQ ID NO: 16483 - DNA, 33 bp, Artificial Sequence
  Primer
tttggtaccctgatatgaaggctaacagtgacg

SEQ ID NO: 16484 - DNA, 35 bp, Artificial Sequence
  Primer
tttggtaccttactctttttacatctccaggcagc

SEQ ID NO: 16485 - DNA, 32 bp, Artificial Sequence
  Primer
tttggtaccttatcatccgcttgcattatcac
